United States Patent 11,805,774 (SEED TREATMENT METHODS AND COMPOSITIONS FOR IMPROVING PLANT TRAITS AND YIELD) - sequence listing, part 3

SEQ ID NO: 3723 - DNA, 1497 bp, Erythrobacter sp. QSSC1-22B
  ref <308>: DATABASE ACCESSION NUMBER: NCBI ACCESSION: NZ_LZRP01000012.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaacctgcctttaggttcgggataacagttggaaacgactgctaataccgaataatgtcttcggaccaaagatttatcgcctttagatgggcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttactggggatgataatgacagtacccagagaataagctccggctaactccgtgccagcagccgcggtaatacggagggagctagcgttgttcggaattactgggcgtaaagcgcgcgtaggcggcttatcaagtcaggggtgaaatcccggggctcaaccccggaactgcctctgaaactggtagactagaatactggagaggcgagtggaattccgagtgtagaggtgaaattcgtagatattcggaagaacaccagtggcgaaggcgactcgctggacagttattgacgctgaggtgcgaaagcgtggggagcaaacaggattagataccctggtagtccacgccgtaaacgatgataactagctgtccgggctcttagagcctgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattggactctgcaactcgagtccatgaaggcggaatcgctagtaatcgcggatcagcatgccgcggtgaatacgttcccaggccttgtacacaccgcccgtcacaccatgggagttggattcacccgaaggtggtgcgctaacctgcttgcaggaggcagccaaccacggtgggttcagcgactggggtgaagtcgtaacaaggtagccgtaggggaacctgcggctggatcacctcctttctaagga

SEQ ID NO: 3724 - DNA, 1492 bp, Erythrobacter sp. SAORIC-644
  ref <308>: DATABASE ACCESSION NUMBER: NCBI ACCESSION: NZ_POYF01000020.1
  ref <309>: DATABASE ENTRY DATE: 2019-04-01
  ref <313>: RELEVANT RESIDUES IN SEQ ID NO: (1)..(1492)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataacagttagaaatgactgctaataccggataatgtcttcggaccaaagatttattgcctttagatgggcccgcgttggattagatagttggtggggtaatggcctaccaagtcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcttttcaagtcaggggtgaaatcccggggctcaaccccggaactgcccttgaaactggatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgtccgggctcatggagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcggtgcgctaaccttttaggaggcagccgaccacggtgggttcagcgactggggtgaagtcgtaacaaggtagccgtaggggaacctgcggctggatcacctcctttctaag

SEQ ID NO: 3725 - DNA, 476 bp, Erythrobacter sp. SD-21
  ref <308>: DATABASE ACCESSION NUMBER: NCBI ACCESSION: NZ_ABCG01000013.1
  ref <309>: DATABASE ENTRY DATE: 2019-04-01
  ref <313>: RELEVANT RESIDUES IN SEQ ID NO: (1)..(476)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataactcagagaaatttgagctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagatagctccggctactccgtgccagcagccgcggtaata

SEQ ID NO: 3726 - DNA, 1497 bp, Erythrobacter sp. SG61-1L
  ref <308>: DATABASE ACCESSION NUMBER: NCBI ACCESSION: NZ_JXQC01000003.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagaccttcgggtctagtggcgcacgggtgcgtaacgcgtgggaacctgcccttaggttcggaataactcagagaaatttgagctaataccggataatgtcttcggaccaaagatttatcgcctttggatgggcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctcagcaagtcaggggtgaaatcccggggctcaaccccggaactgcctttgaaactgctaggctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggattagagagatcttttccttcagttcggctggaccagtgacaggtgctgcatggctgtcgtcagctcgtgtcgtgagatgttgggttaagtcccgcaacgagcgcaaccctcgtccttagttgccatcatttagttgggcactctaaggaaactgccggtgataagccggaggaaggtggggatgacgtcaagtcctcatggcccttacaggctgggctacacacgtgctacaatggcgatgacagtgagcagctagaccgcgaggtcgtgctaatctctaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcgctgcgctaactcgcaagagaggcaggcgaccacggtgggatcagcgactggggtgaagtcgtaacaaggtagccgtaggggaacctgcggctggatcacctcctttctaagga

SEQ ID NO: 3727 - DNA, 1491 bp, Erythrobacter sp. V18
  ref <308>: DATABASE ACCESSION NUMBER: NCBI ACCESSION: NZ_QXFL01000004.1
  ref <309>: DATABASE ENTRY DATE: 2019-04-01
  ref <313>: RELEVANT RESIDUES IN SEQ ID NO: (1)..(1491)
caaacttgagagtttgatcctggctcagaacgaacgctggcggcatgcctaacacatgcaagtcgaacgaacccttcggggtgagtggcgcacgggtgcgtaacgcgtgggaacctgcccttaggtttggaataacagtgagaaatcgctgctaataccaaataatgtcttcggaccaaagatttatcgcctttggatgggcccgcgttggattagctagttggtggggtaaaggctcaccaaggcgacgatccatagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgcgcgtaggcggcttttcaagtcaggggtgaaatcccggggctcaaccccggaactgcccttgaaactggatcgctagaatactggagaggcaagtggaattccgagtgtagaggtgaaattcgtagatattcggaagaacaccagtggcgaaggcgacttgctggacagtgattgacgctgaggtgcgaaagcgtggggagcaaacaggattagataccctggtagtccacgccgtaaacgatgataactagctgtccgggttcacagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatccttcgacggtttctggagacagattccttccttcgggacgaagtgacaggtgctgcatggctgtcgtcagctcgtgtcgtgagatgttgggttaagtcccgcaacgagcgcaaccctcatccttagttgccatcatttagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaaggtggtgcgctaaccggtttaccggaggcagccaaccacggtgggatcagcgactggggtgaagtcgtaacaaggtagccgtaggggaacctgcggctggatcacctcctttcta

SEQ ID NO: 3728 - DNA, 1494 bp, Erythrobacter sp. YH-07
  ref <308>: DATABASE ACCESSION NUMBER: NCBI ACCESSION: NZ_CP031357.1
  ref <309>: DATABASE ENTRY DATE: 2019-04-01
  ref <313>: RELEVANT RESIDUES IN SEQ ID NO: (1)..(1494)
caaacttgagagtttgatcctggctcagaacgaacgctggcggcatgcctaacacatgcaagtcgaacgaagccttcgggcttagtggcgcacgggtgcgtaacgcgtgggaacctgcctttaggttcggaataacagttagaaatgactgctaataccggataatgtcttcggaccaaagatttatcgcctttagatgggcccgcgttggattagatagttggtggggtaatggcctaccaagtcgacgatccatagctggtctgagaggatgatcagccacactgggactgagacacggcccagactcctacgggaggcagcagtggggaatattggacaatgggggcaaccctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcttttcaagtcaggggtgaaatcccggggctcaaccccggaactgcccttgaaactggatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacggggcctgcacaagcggtggagcatgtggtttaattcgaagcaacgcgcagaaccttaccagcctttgacatcctaggacggtttctggagacagattcttttccttcgggaacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtggtgcgctaacctgcttgcaggaggcagccaaccacggtgggttcagcgactggggtgaagtcgtaacaaggtagccgtaggggaacctgcggctggatcacctcctttctaag

SEQ ID NO: 3729 - DNA, 1494 bp, Erythrobacter sp. YT30
  ref <308>: DATABASE ACCESSION NUMBER: NCBI ACCESSION: NZ_LMAF01000002.1
  ref <309>: DATABASE ENTRY DATE: 2019-04-01
  ref <313>: RELEVANT RESIDUES IN SEQ ID NO: (1)..(1494)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataactcagagaaatttgagctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttactagggatgataatgacagtacctagagaataagctccggctaactccgtgccagcagccgcggtaatacggagggagctagcgttgttcggaattactgggcgtaaagcgcgcgtaggcggcttttcaagtcaggggtgaaatcccggagctcaactccggaactgcccttgaaactggatggctagaatattggagaggtaagtggaattccgagtgtagaggtgaaattcgtagatattcggaagaacaccagtggcgaaggcgacttactggacaattattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgatttctggagacagatctctttccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaagatagtgcgctaaccttttaggaggcagctagccacggtgggatcagcgactggggtgaagtcgtaacaaggtagccgtaggggaacctgcggctggatcacctcctttctaagga

SEQ ID NO: 3730 - DNA, 1497 bp, Erythrobacter vulgaris
  ref <308>: DATABASE ACCESSION NUMBER: NCBI ACCESSION: NZ_CCSI01000004.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataactcagagaaatttgagctaataccggatgatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggcttttcaagtcaggggtgaaatcccggggctcaaccccggaactgcccttgaaactggatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgtccgggctcatggagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagattccttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtggtgcgctaaccagtttactggaggcagccaaccacggtgggttcagcgactggggtgaagtcgtaacaaggtagccgtaggggaacctgcggctggatcacctcctttctaagga

SEQ ID NO: 3731 - DNA, 1487 bp, Erythrobacter xanthus
  ref <308>: DATABASE ACCESSION NUMBER: NCBI ACCESSION: NZ_QXFM01000071.1
  ref <309>: DATABASE ENTRY DATE: 2019-04-01
  ref <313>: RELEVANT RESIDUES IN SEQ ID NO: (1)..(1487)
caaacttgagagtttgatcctggctcagaacgaacgctggcggcatgcctaacacatgcaagtcgaacgagctcttcggagctagtggcgcacgggtgcgtaacgcgtgggaacctgcccttaggttcggaataacagtgagaaatcgctgctaataccggataatgtcttcggaccaaagatttatcgcctttggatgggcccgcgtaggattagctagttggtgaggtaatggctcaccaaggcgacgatccttagctggtcttagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaaatactgggcgtaaagcgcacgtaggcggcgtcgtaagtcaggggtgaaatcccggggctcaaccccggaactgcccttgaaactgcaatgctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctctgacgaatcaggagactgattttttccttcgggacagagtgacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacaggctgggctacacacgtgctacaatggcaactacagtgggcagctatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaagatggtgcgctaaccttttaggaggcagccagccacggtgggatcagcgactggggtgaagtcgtaacaaggtagccgtaggggaacctgcggctggatcacctcctttcta

SEQ ID NO: 3732 - DNA, 1491 bp, Erythrobacteraceae bacterium CCH12-C2
  ref <308>: DATABASE ACCESSION NUMBER: NCBI ACCESSION: NZ_LSKF01000026.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgagaccttcgggtctagtggcgcacgggtgcgtaacgcgtgggaacctgccttttggttcggaataactcagagaaatttgagctaataccggataatgtcttcggaccaaagatttatcgccattagatgggcccgcgtaagattagctagttggtggggtaaaggcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatctacagtgggcagctatcccgcaagggtgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 3733 - DNA, 1491 bp, Erythrobacteraceae bacterium SX2RGS8
  ref <308>: DATABASE ACCESSION NUMBER: NCBI ACCESSION: NZ_QZVQ01000027.1
  ref <309>: DATABASE ENTRY DATE: 2019-04-01
  ref <313>: RELEVANT RESIDUES IN SEQ ID NO: (1)..(1491)
caaacttgagagtttgatcctggctcagaacgaacgctggcggcatgcctaacacatgcaagtcgaacgagaccttcgggtctagtggcgcacgggtgcgtaacgcgtgggaacctgcctttaggttcgggataactcctcgaaaggggtgctaataccggatgatgtcttcggaccaaagatttatcgcctttagatgggcccgcgttggattagctagttggtgaggtaaaggctcaccaaggcgacgatccatagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaaatactgggcgtaaagcgaacgtaggcggcttggcaagtcaggggtgaaatcccagtgctcaacactggaactgcctttgaaactgccaggcttgaatcctggagaggcgagtggaattccgagtgtagaggtgaaattcgtagatattcggaagaacaccagtggcgaaggcgactcgctggacaggtattgacgctgaggttcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctcggacgacttctggagacagatttcttcccttttgggaccgagtgacaggtgctgcatggctgtcgtcagctcgtgtcgtgagatgttgggttaagtcccgcaacgagcgcaaccctcgtccttagttgccatcattaagttgggaactctaaggaaaccgccggtgataagccggaggaaggtggggatgacgtcaagtcctcatggcccttacaggctgggctacacacgtgctacaatggcatctacagtgggcagctaactcgcaagggtgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacgccatgggagttggttctacccgaaggtggtgcgctaacccgcaagggaggcagccaaccacggtgggatcagcgactggggtgaagtcgtaacaaggtagccgtaggggaacctgcggctggatcacctcctttcta

SEQ ID NO: 3734 - DNA, 1552 bp, Escherichia albertii
  ref <308>: DATABASE ACCESSION NUMBER: NCBI ACCESSION: NZ_CP034213.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagaagcttgcttctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatagctttgctcattgacgttacccgcagaagaagcaccggctaactccgtgccagcagccgcggtaatacggagggtgcaagcgttaatcggaattactgggcgtaaagcgcacgcaggcggttgattaagtcagatgtgaaatccccgggctcaacctgggaactgcatctgatactggtcagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtcaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 3735 - DNA, 1554 bp, Escherichia coli
  ref <308>: DATABASE ACCESSION NUMBER: NCBI ACCESSION: NZ_LR134340.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacagaaagaagcttgcttctttgctgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagtaggcggggtaacggcccacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacattccagagatgggatggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3736 - DNA, 1552 bp, Escherichia fergusonii
  ref <308>: DATABASE ACCESSION NUMBER: NCBI ACCESSION: NZ_RWHS01000154.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaatcagcttgctgattcgctgacgagtggcggacgggtgagtaatgtctgggaaactgcctgatggagggggataactactggaaacggtagctaataccgcataatgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3737 - DNA, 1554 bp, Escherichia sp. 1 1 43
  ref <308>: DATABASE ACCESSION NUMBER: NCBI ACCESSION: NZ_JH815272.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3738 - DNA, 1554 bp, Escherichia sp. E13S3
  ref <308>: DATABASE ACCESSION NUMBER: NCBI ACCESSION: NZ_RHJR01000025.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaatcagcttgctgattcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3739 - DNA, 1552 bp, Escherichia sp. E14S1
  ref <308>: DATABASE ACCESSION NUMBER: NCBI ACCESSION: NZ_RHJQ01000009.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacagaaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3740 - DNA, 1554 bp, Escherichia sp. E14V10
  ref <308>: DATABASE ACCESSION NUMBER: NCBI ACCESSION: NZ_RHJL01000018.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaatcagcttgctgattcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3741 - DNA, 1554 bp, Escherichia sp. E14V5
  ref <308>: DATABASE ACCESSION NUMBER: NCBI ACCESSION: NZ_RHJK01000015.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3742 - DNA, 1554 bp, Escherichia sp. E14V7; identical to SEQ ID NO: 3740
  ref <308>: DATABASE ACCESSION NUMBER: NCBI ACCESSION: NZ_RHJJ01000033.1
  ref <309>: DATABASE ENTRY DATE: 2019-04-01
  ref <313>: RELEVANT RESIDUES IN SEQ ID NO: (1)..(1554)

SEQ ID NO: 3743 - DNA, 1554 bp, Escherichia sp. E1V33
  ref <308>: DATABASE ACCESSION NUMBER: NCBI ACCESSION: NZ_RHJI01000053.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3744 - DNA, 1459 bp, Escherichia sp. MOD1-EC1915
  ref <308>: DATABASE ACCESSION NUMBER: NCBI ACCESSION: NZ_PTRQ01000103.1
  ref <309>: DATABASE ENTRY DATE: 2019-04-01
  ref <313>: RELEVANT RESIDUES IN SEQ ID NO: (1)..(1459)
gctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3745 - DNA, 1545 bp, Escherichia sp. MOD1-EC2449
  ref <308>: DATABASE ACCESSION NUMBER: NCBI ACCESSION: NZ_PTRP01000105.1
  ref <309>: DATABASE ENTRY DATE: 2019-04-01
  ref <313>: RELEVANT RESIDUES IN SEQ ID NO: (1)..(1545)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 3746 - DNA, 1552 bp, Escherichia sp. MOD1-EC4516
  ref <308>: DATABASE ACCESSION NUMBER: NCBI ACCESSION: NZ_PTRO01000069.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaatcagcttgctgattcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3747 - DNA, 1552 bp, Escherichia sp. MOD1-EC4550; identical to SEQ ID NO: 3746
  ref <308>: DATABASE ACCESSION NUMBER: NCBI ACCESSION: NZ_PTRN01000024.1
  ref <309>: DATABASE ENTRY DATE: 2019-04-01
  ref <313>: RELEVANT RESIDUES IN SEQ ID NO: (1)..(1552)

SEQ ID NO: 3748 - DNA, 1545 bp, Escherichia sp. MOD1-EC4560; identical to SEQ ID NO: 3745
  ref <308>: DATABASE ACCESSION NUMBER: NCBI ACCESSION: NZ_PTRY01000072.1
  ref <309>: DATABASE ENTRY DATE: 2019-04-01
  ref <313>: RELEVANT RESIDUES IN SEQ ID NO: (1)..(1545)

SEQ ID NO: 3749 - DNA, 1554 bp, Escherichia sp. MOD1-EC5110
  ref <308>: DATABASE ACCESSION NUMBER: NCBI ACCESSION: NZ_PTTC01000080.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacagaaagaagcttgcttctttgctgacgagtggcggacgggtgagtaatgtctgggaagctgcccgatggagggggataactactggaaacggtagctaataccgcataacgtcgcaagaccaaagagggggaccttcgggcctcttgccatcggatgtgcccagatgggattagctagtaggcggggtaacggcccacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacattccagagatgggatggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3750 - DNA, 1029 bp, Escherichia sp. MOD1-EC5189
  ref <308>: DATABASE ACCESSION NUMBER: NCBI ACCESSION: NZ_PTRX01000020.1
  ref <309>: DATABASE ENTRY DATE: 2019-04-01
  ref <313>: RELEVANT RESIDUES IN SEQ ID NO: (1)..(1029)
aaattgaagagtttgatcatggctcagattgaacgctggcggcaggcctaacacatgcaagtcgaacggtaacaggaatcagcttgctgattcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgcct

SEQ ID NO: 3751 - DNA, 1552 bp, Escherichia sp. MOD1-EC5287; identical to SEQ ID NO: 3746
  ref <308>: DATABASE ACCESSION NUMBER: NCBI ACCESSION: NZ_PTRW01000080.1
  ref <309>: DATABASE ENTRY DATE: 2019-04-01
  ref <313>: RELEVANT RESIDUES IN SEQ ID NO: (1)..(1552)

SEQ ID NO: 3752 - DNA, 1552 bp, Escherichia sp. MOD1-EC5350
  ref <308>: DATABASE ACCESSION NUMBER: NCBI ACCESSION: NZ_PTRM01000065.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggataggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3753 - DNA, 1552 bp, Escherichia sp. MOD1-EC5426
  ref <308>: DATABASE ACCESSION NUMBER: NCBI ACCESSION: NZ_PTTB01000062.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacagaaagaagcttgcttctttgctgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagtaggcggggtaacggcccacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacattccagagatgggatggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3754 - DNA, 1552 bp, Escherichia sp. MOD1-EC5427
  ref <308>: DATABASE ACCESSION NUMBER: NCBI ACCESSION: NZ_PTTA01000030.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacagaaagaagcttgcttctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggcggggtaacggcccacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacattccagagatgggatggtgccttcgggaactgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3755 - DNA, 1554 bp, Escherichia sp. MOD1-EC5433
  ref <308>: DATABASE ACCESSION NUMBER: NCBI ACCESSION: NZ_PTRL01000017.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaatcagcttgctgattcgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatctgatactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3756 - DNA, 1554 bp, Escherichia sp. MOD1-EC5434
  ref <308>: DATABASE ACCESSION NUMBER: NCBI ACCESSION: NZ_PTRK01000040.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatctgatactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3757 - DNA, 1552 bp, Escherichia sp. MOD1-EC5438; identical to SEQ ID NO: 3753
  ref <308>: DATABASE ACCESSION NUMBER: NCBI ACCESSION: NZ_PTSZ01000061.1
  ref <309>: DATABASE ENTRY DATE: 2019-04-01
  ref <313>: RELEVANT RESIDUES IN SEQ ID NO: (1)..(1552)

SEQ ID NO: 3758 - DNA, 1554 bp, Escherichia sp. MOD1-EC5449; identical to SEQ ID NO: 3735
  ref <308>: DATABASE ACCESSION NUMBER: NCBI ACCESSION: NZ_PTSY01000065.1
  ref <309>: DATABASE ENTRY DATE: 2019-04-01
  ref <313>: RELEVANT RESIDUES IN SEQ ID NO: (1)..(1554)

SEQ ID NO: 3759 - DNA, 1554 bp, Escherichia sp. MOD1-EC5457
  ref <308>: DATABASE ACCESSION NUMBER: NCBI ACCESSION: NZ_PTRJ01000009.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatctgatactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3760 - DNA, 1552 bp, Escherichia sp. MOD1-EC5462; identical to SEQ ID NO: 3753
  ref <308>: DATABASE ACCESSION NUMBER: NCBI ACCESSION: NZ_PTSW01000077.1
  ref <309>: DATABASE ENTRY DATE: 2019-04-01
  ref <313>: RELEVANT RESIDUES IN SEQ ID NO: (1)..(1552)

SEQ ID NO: 3761 - DNA, 1554 bp, Escherichia sp. MOD1-EC5495
  ref <308>: DATABASE ACCESSION NUMBER: NCBI ACCESSION: NZ_PTRI01000051.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacagggatcagcttgctgattcgctgacgagtggcggacgggtgagtaatgtctgggaaactgcccgatggagggggataactactggaaacggtagctaataccgcataacgtcgcaagaccaaagagggggaccttcgggcctcttgccattggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatctgatactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3762 - DNA, 1552 bp, Escherichia sp. MOD1-EC5948; identical to SEQ ID NO: 3753
  ref <308>: DATABASE ACCESSION NUMBER: NCBI ACCESSION: NZ_PTST01000108.1
  ref <309>: DATABASE ENTRY DATE: 2019-04-01
  ref <313>: RELEVANT RESIDUES IN SEQ ID NO: (1)..(1552)

SEQ ID NO: 3763 - DNA, 1552 bp, Escherichia sp. MOD1-EC5949
  ref <308>: DATABASE ACCESSION NUMBER: NCBI ACCESSION: NZ_PTSS01000072.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacagaaagaagcttgcttctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggcggggtaacggcccacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacattccagagatgggatggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3764 - DNA, 1552 bp, Escherichia sp. MOD1-EC5950; identical to SEQ ID NO: 3763
  ref <308>: DATABASE ACCESSION NUMBER: NCBI ACCESSION: NZ_PTSR01000079.1
  ref <309>: DATABASE ENTRY DATE: 2019-04-01
  ref <313>: RELEVANT RESIDUES IN SEQ ID NO: (1)..(1552)

SEQ ID NO: 3765 - DNA, 1552 bp, Escherichia sp. MOD1-EC5990; identical to SEQ ID NO: 3746
  ref <308>: DATABASE ACCESSION NUMBER: NCBI ACCESSION: NZ_PTRV01000060.1
  ref <309>: DATABASE ENTRY DATE: 2019-04-01
  ref <313>: RELEVANT RESIDUES IN SEQ ID NO: (1)..(1552)

SEQ ID NO: 3766 - DNA, 1552 bp, Escherichia sp. MOD1-EC6021; identical to SEQ ID NO: 3746
  ref <308>: DATABASE ACCESSION NUMBER: NCBI ACCESSION: NZ_PTRU01000088.1
  ref <309>: DATABASE ENTRY DATE: 2019-04-01
  ref <313>: RELEVANT RESIDUES IN SEQ ID NO: (1)..(1552)

SEQ ID NO: 3767 - DNA, 1554 bp, Escherichia sp. MOD1-EC6096; identical to SEQ ID NO: 3735
  ref <308>: DATABASE ACCESSION NUMBER: NCBI ACCESSION: NZ_PTSP01000136.1
  ref <309>: DATABASE ENTRY DATE: 2019-04-01
  ref <313>: RELEVANT RESIDUES IN SEQ ID NO: (1)..(1554)

SEQ ID NO: 3768 - DNA, 1554 bp, Escherichia sp. MOD1-EC6097
  ref <308>: DATABASE ACCESSION NUMBER: NCBI ACCESSION: NZ_PTSO01000172.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacagaaagaagcttgcttctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggcggggtaacggcccacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacattccagagatgggatggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3769 - DNA, 1554 bp, Escherichia sp. MOD1-EC6098; identical to SEQ ID NO: 3768
  ref <308>: DATABASE ACCESSION NUMBER: NCBI ACCESSION: NZ_PTSN01000068.1
  ref <309>: DATABASE ENTRY DATE: 2019-04-01
  ref <313>: RELEVANT RESIDUES IN SEQ ID NO: (1)..(1554)

SEQ ID NO: 3770 - DNA, 1554 bp, Escherichia sp. MOD1-EC6099; identical to SEQ ID NO: 3768
  ref <308>: DATABASE ACCESSION NUMBER: NCBI ACCESSION: NZ_PTSM01000060.1
  ref <309>: DATABASE ENTRY DATE: 2019-04-01
  ref <313>: RELEVANT RESIDUES IN SEQ ID NO: (1)..(1554)

SEQ ID NO: 3771 - DNA, 1552 bp, Escherichia sp. MOD1-EC6100; identical to SEQ ID NO: 3763
  ref <308>: DATABASE ACCESSION NUMBER: NCBI ACCESSION: NZ_PTSL01000066.1
  ref <309>: DATABASE ENTRY DATE: 2019-04-01
  ref <313>: RELEVANT RESIDUES IN SEQ ID NO: (1)..(1552)

SEQ ID NO: 3772 - DNA, 1552 bp, Escherichia sp. MOD1-EC6144; identical to SEQ ID NO: 3763
  ref <308>: DATABASE ACCESSION NUMBER: NCBI ACCESSION: NZ_PTSK01000092.1
  ref <309>: DATABASE ENTRY DATE: 2019-04-01
  ref <313>: RELEVANT RESIDUES IN SEQ ID NO: (1)..(1552)

SEQ ID NO: 3773 - DNA, 1552 bp, Escherichia sp. MOD1-EC6147; identical to SEQ ID NO: 3763
  ref <308>: DATABASE ACCESSION NUMBER: NCBI ACCESSION: NZ_PTSI01000107.1
  ref <309>: DATABASE ENTRY DATE: 2019-04-01
  ref <313>: RELEVANT RESIDUES IN SEQ ID NO: (1)..(1552)

SEQ ID NO: 3774 - DNA, 1552 bp, Escherichia sp. MOD1-EC6149; identical to SEQ ID NO: 3754
  ref <308>: DATABASE ACCESSION NUMBER: NCBI ACCESSION: NZ_PTSH01000105.1
  ref <309>: DATABASE ENTRY DATE: 2019-04-01
  ref <313>: RELEVANT RESIDUES IN SEQ ID NO: (1)..(1552)

SEQ ID NO: 3775 - DNA, 1552 bp, Escherichia sp. MOD1-EC6150; identical to SEQ ID NO: 3753
  ref <308>: DATABASE ACCESSION NUMBER: NCBI ACCESSION: NZ_PTSG01000081.1
  ref <309>: DATABASE ENTRY DATE: 2019-04-01
  ref <313>: RELEVANT RESIDUES IN SEQ ID NO: (1)..(1552)

SEQ ID NO: 3776 - DNA, 1554 bp, Escherichia sp. MOD1-EC6153; identical to SEQ ID NO: 3768
  ref <308>: DATABASE ACCESSION NUMBER: NCBI ACCESSION: NZ_PTSF01000068.1
  ref <309>: DATABASE ENTRY DATE: 2019-04-01
  ref <313>: RELEVANT RESIDUES IN SEQ ID NO: (1)..(1554)

SEQ ID NO: 3777 - DNA, 1552 bp, Escherichia sp. MOD1-EC6154; identical to SEQ ID NO: 3753
  ref <308>: DATABASE ACCESSION NUMBER: NCBI ACCESSION: NZ_PTSE01000099.1
  ref <309>: DATABASE ENTRY DATE: 2019-04-01
  ref <313>: RELEVANT RESIDUES IN SEQ ID NO: (1)..(1552)

SEQ ID NO: 3778 - DNA, 1552 bp, Escherichia sp. MOD1-EC6157; identical to SEQ ID NO: 3753
  ref <308>: DATABASE ACCESSION NUMBER: NCBI ACCESSION: NZ_PTSD01000102.1
  ref <309>: DATABASE ENTRY DATE: 2019-04-01
  ref <313>: RELEVANT RESIDUES IN SEQ ID NO: (1)..(1552)

SEQ ID NO: 3779 - DNA, 1552 bp, Escherichia sp. MOD1-EC6158; identical to SEQ ID NO: 3763
  ref <308>: DATABASE ACCESSION NUMBER: NCBI ACCESSION: NZ_PTSC01000119.1
  ref <309>: DATABASE ENTRY DATE: 2019-04-01
  ref <313>: RELEVANT RESIDUES IN SEQ ID NO: (1)..(1552)

SEQ ID NO: 3780 - DNA, 1552 bp, Escherichia sp. MOD1-EC6162; identical to SEQ ID NO: 3754
  ref <308>: DATABASE ACCESSION NUMBER: NCBI ACCESSION: NZ_PTSB01000070.1
  ref <309>: DATABASE ENTRY DATE: 2019-04-01
  ref <313>: RELEVANT RESIDUES IN SEQ ID NO: (1)..(1552)

SEQ ID NO: 3781 - DNA, 1554 bp, Escherichia sp. MOD1-EC6163; identical to SEQ ID NO: 3768
  ref <308>: DATABASE ACCESSION NUMBER: NCBI ACCESSION: NZ_PTSA01000109.1
  ref <309>: DATABASE ENTRY DATE: 2019-04-01
  ref <313>: RELEVANT RESIDUES IN SEQ ID NO: (1)..(1554)

SEQ ID NO: 3782 - DNA, 1552 bp, Escherichia sp. MOD1-EC6300
  ref <308>: DATABASE ACCESSION NUMBER: NCBI ACCESSION: NZ_PTRH01000045.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3783 - DNA, 1554 bp, Escherichia sp. MOD1-EC6819
  ref <308>: DATABASE ACCESSION NUMBER: NCBI ACCESSION: NZ_PTRG01000035.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatctgatactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3784 - DNA, 1554 bp, Escherichia sp. MOD1-EC6842
  ref <308>: DATABASE ACCESSION NUMBER: NCBI ACCESSION: NZ_PTRF01000050.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatctgatactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtttggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3785 - DNA, 1552 bp, Escherichia sp. MOD1-EC7003
  ref <308>: DATABASE ACCESSION NUMBER: NCBI ACCESSION: NZ_PTRE01000063.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttagggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatagctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatcctcagaatcctgtagagatacgggagtgccttcgggaactgagagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3786 - DNA, 1502 bp, Escherichia sp. MOD1-EC7011
  ref <308>: DATABASE ACCESSION NUMBER: NCBI ACCESSION: NZ_PTRD01000004.1
  ref <309>: DATABASE ENTRY DATE: 2019-04-01
  ref <313>: RELEVANT RESIDUES IN SEQ ID NO: (1)..(1502)
acatgcaagtcgaacggtaacagaaatcagcttgctgatttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtttggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3787 - DNA, 1554 bp, Escherichia sp. TW11588; identical to SEQ ID NO: 3783
  ref <308>: DATABASE ACCESSION NUMBER: NCBI ACCESSION: NZ_AEMF01000001.1
  ref <309>: DATABASE ENTRY DATE: 2019-04-01
  ref <313>: RELEVANT RESIDUES IN SEQ ID NO: (1)..(1554)

SEQ ID NO: 3788 - DNA, 1504 bp, Ethanoligenens harbinense
  ref <308>: DATABASE ACCESSION NUMBER: NCBI ACCESSION: NZ_CP025288.1
  ref <309>: DATABASE ENTRY DATE: 2019-04-01
  ref <313>: RELEVANT RESIDUES IN SEQ ID NO: (1)..(1504)
ttggagagtttgatcctggctcaggacgaacgctggcggcgcgcctaacacatgcaagtcgagcggagtccttcgggacttagcggcggacgggtgagtaacgcgtgagcaacctggccttcagagggggataacgtctggaaacggacgctaataccgcatgacatggcggagtcgcatggctctgccatcaaaggagtaatccgctgagggatgggctcgcgtccgattaggtagttggtgaggtaacggctcaccaagcccgcgatcggtagccggactgagaggttggccggccacattgggactgagacacggcccagactcctacgggaggcagcagtgggggatattgcacaatggaggaaactctgatgcagcgacgccgcgtgagggaagaaggtcttcggattgtaaacctctgtctttggggacgaatcaatgacggtacccaaggaggaagccacggctaactacgtgccagcagccgcggtaatacgtaggtggcaagcgttgtccggaattactgggtgtaaagggtgcgcaggcggggcggcaagttggatgtgaaaactccgggctcaacccggagcctgcattcaaaactgtcgctcttgagtgaagtagaggcaggcggaattcccggtgtagcggtgaaatgcgtagatatcgggaggaacaccagtggcgaaggcggcctgctgggcttttactgacgctgaggcacgaaagcatgggtagcaaacaggattagataccctggtagtccatgccgtaaacgatgattgctaggtgtggggggtctgaccccttccgtgccggagttaacacaataagcaatccacctggggagtacggccgcaaggttgaaactcaaaggaattgacgggggcccgcacaagcagtggagtatgtggtttaattcgaagcaacgcgaagaaccttaccaggtcttgacatccaccgaatcccccagagatgggggagtgcccttcggggagcggtgagacaggtggtgcatggttgtcgtcagctcgtgtcgtgagatgttgggttaagtcccgcaacgagcgcaacccttgtgaatagttgctacgaaagagcactctattcagaccgccgttgacaaaacggaggaaggtggggatgacgtcaaatcatcatgccccttatgacctgggctacacacgtactacaatggccatcaacagagggaagcaaggccgcgaggtggagcgaacccctaaaaatggtctcagttcagattgcaggctgaaacccgcctgcatgaagatggaattgctagtaatcgcggatcagcatgccgcggtgaatacgttcccgggccttgtacacaccgcccgtcacaccatgagagccggggacacccgaagtcggttgggtaaccgtaaggagcccgccgccgaaggtggaatcggtaattggggtgaagtcgtaacaaggtagccgtatcggaaggtgcggctggatcacctcctttcta

SEQ ID NO: 3789 - DNA, 1314 bp, Eubacterium callanderi
  ref <308>: DATABASE ACCESSION NUMBER: NCBI ACCESSION: NZ_FRBP01000027.1
  ref <309>: DATABASE ENTRY DATE: 2019-04-01
  ref <313>: RELEVANT RESIDUES IN SEQ ID NO: (1)..(1314)
agatcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaacatgacggtacccaatgaggaagtcccggctaactacgtgccagcagccgcggtaatacgtaggggacaagcgttgtccggaatgactgggcgtaaagggcgcgtaggcggtctattaagtctgatgtgaaaggtaccggctcaaccggtgaagtgcattggaaactggtagacttgagtattggagaggcaagtggaattcctagtgtagcggtgaaatgcgtagatattaggaggaacaccagtggcgaaggcggcttgctggacaaatactgacgctgaggtgcgaaagcgtggggagcgaacaggattagataccctggtagtccacgccgtaaacgatgaatgctaggtgttggggaaactcagtgccgcagttaacacaataagcattccgcctggggagtacgaccgcaaggttgaaactcaaaggaattgacggggacccgcacaagcagcggagcatgtggtttaattcgaagcaacgcgaagaaccttaccaggtcttgacatcctctgacgagcctagagataggaagtttccttcgggaacagagagacaggtggtgcatggttgtcgtcagctcgtgtcgtgagatgttgggttaagtcccgcaacgagcgcaacccctgcctttagttgccagcattaagttgggcactctagagggactgccgtagacaatacggaggaaggtggggatgacgtcaaatcatcatgccccttatgacctgggctacacacgtgctacaatggtctgaacagagggccgcgaagccgcgaggtgaagcaaatcccttaaaacagatcccagttcggattgcaggctgcaactcgcctgcatgaagttggagttgctagtaatcgcggatcagaatgccgcggtgaatgcgttcccgggtcttgtacacaccgcccgtcacaccacgagagttggcaacacccgaagcctgtgagagaaccgcaaggactcagcagtcgaaggtggggctagtaattggggtgaagtcgtaacaaggtagccgtatcggaaggtgcggctggatcacctcctttcta

SEQ ID NO: 3790 - DNA, 1336 bp, Eubacterium coprostanoligenes
  ref <308>: DATABASE ACCESSION NUMBER: NCBI ACCESSION: NZ_FUWW01000033.1
  ref <309>: DATABASE ENTRY DATE: 2019-04-01
  ref <313>: RELEVANT RESIDUES IN SEQ ID NO: (1)..(1336)
tgatggcatcattgatgtaccaaagctattgcgctgaaggatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggcgcaagcctgatgcagcaacgccgcgtggaggaagacggttttcggattgtaaactcctgttcttagtgaagaaaaatgacggtagctaaggagcaagccacggctaactacgtgccagcagccgcggtaatacgtaggtggcaagcgttgtccggaattactgggtgtaaagggagcgcaggcgggggagcaagtcagctgtgaaatctatgggcttaacccataaactgcagttgaaactgttcttcttgagtgaagtagaggttggcggaattccgagtgtagcggtgaaatgcgtagatattcggaggaacaccggtggcgaaggcggccaactgggcttttactgacgctgaggctcgaaagtgtggggagcaaacaggattagataccctggtagtccacactgtaaacgatgataactaggtgtagggggtctgaccccttctgtgccgcagctaacgcaataagttatccacctggggagtacgaccgcaaggttgaaactcaaaggaattgacggggacccgcacaagcagtggattatgtggtttaattcgatgcaacgcgaagaaccttaccagcacttgacatccaactaacgaaatagagatatattaggtgcccctcggggaaagttgagacaggtggtgcatggttgtcgtcagctcgtgtcgtgagatgttgggttaagtcccgcaacgagcgcaacccctgccattagttgctacgcaagagcactctaatgggaccgctaccgacaaggtggaggaaggtggggatgacgtcaaatcatcatgccccttatgtgctgggctacacacgtaatacaatggtcgttaacaaagagaagcaataccgcgaggtggagcaaaacttcaaaaacgatctcagttcggactgtaggctgaaactcgcctgcacgaagttggaattgctagtaatcgtggatcagcatgccacggtgaatacgttcccgggtcttgtacacaccgcccgtcacaccatgggagccggtaatacccgaagtcagtagtctaaccttaatggaggacgctgccgaaggtaggattggcgactggggtgaagtcgtaacaaggtagccgtaggagaacctgcggctggatcacctcctttctatgga

SEQ ID NO: 3791 - DNA, 1526 bp, Eubacterium limosum
  ref <308>: DATABASE ACCESSION NUMBER: NCBI ACCESSION: NZ_FNJF01000076.1
  ref <309>: DATABASE ENTRY DATE: 2019-04-01
  ref <313>: RELEVANT RESIDUES IN SEQ ID NO: (1)..(1526)
ttattgagagtttgatcctggctcaggacgaacgctggcggtatgcttaacacatgcaagtcgaacgagaagatcagttaagaaccttcgggggaaaaagtgattggaaagtggcgaacgggtgagtaacgcgtgggtaacctgccctatggaaaggaatagcctcgggaaactgggagtaaagccttatattatggagagatcgcatggtcatttcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaacatgacggtacccaatgaggaagtcccggctaactacgtgccagcagccgcggtaatacgtaggggacaagcgttgtccggaatgactgggcgtaaagggcgcgtaggcggtctgataagtcagatgtgaaaggtaccggctcaaccggtgacgtgcatttgaaactgtcagacttgagtattggagaggcaagtggaattcctagtgtagcggtgaaatgcgtagatattaggaggaacaccagtggcgaaggcggcttgctggacaaatactgacgctgaggtgcgaaagcgtggggagcgaacaggattagataccctggtagtccacgccgtaaacgatgaatgctaggtgttggggaaactcagtgccgcagttaacacaataagcattccgcctggggagtacgaccgcaaggttgaaactcaaaggaattgacggggacccgcacaagcagcggagcatgtggtttaattcgaagcaacgcgaagaaccttaccaggtcttgacatcctctgacaatcccagagatgggacgtttccttcgggaacagagagacaggtggtgcatggttgtcgtcagctcgtgtcgtgagatgttgggttaagtcccgcaacgagcgcaacccctgcctttagttgccagcattgagttgggcactctagagggactgccgtagacaatacggaggaaggtggggatgacgtcaaatcatcatgccccttatgacctgggctacacacgtgctacaatggtctgaacagagggccgcgaaaccgcgaggtgaagcaaatcccttaaaacagatcccagttcggattgcaggctgcaactcgcctgcatgaagttggagttgctagtaatcgcggatcagaatgccgcggtgaatgcgttcccgggtcttgtacacaccgcccgtcacaccacgagagttggcaacacccgaagcccgtgagagaaccgtaaggactcagcggtcgaaggtggggctagtaattggggtgaagtcgtaacaaggtagccgtatcggaaggtgcggctggatcacctcctttcta

SEQ ID NO: 3792 - DNA, 1527 bp, Eubacterium maltosivorans
  ref <308>: DATABASE ACCESSION NUMBER: NCBI ACCESSION: NZ_NXNL01000001.1
  ref <309>: DATABASE ENTRY DATE: 2019-04-01
  ref <313>: RELEVANT RESIDUES IN SEQ ID NO: (1)..(1527)
tttattgagagtttgatcctggctcaggacgaacgctggcggtatgcttaacacatgcaagtcgaacgagaagatcagttaagaaccttcgggggaataagtgattggaaagtggcgaacgggtgagtaacgcgtgggtaacctgccctatggaaaggaatagcctcgggaaactgggagtaaagccttatattatggagagatcgcatggtcatttcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaacatgacggtacccaatgaggaagtcccggctaactacgtgccagcagccgcggtaatacgtaggggacaagcgttgtccggaatgactgggcgtaaagggcgcgtaggcggtctgataagtcagatgtgaaaggtaccggctcaaccggtgacgtgcatttgaaactgtcagacttgagtattggagaggcaagtggaattcctagtgtagcggtgaaatgcgtagatattaggaggaacaccagtggcgaaggcggcttgctggacaaatactgacgctgaggtgcgaaagcgtggggagcgaacaggattagataccctggtagtccacgccgtaaacgatgaatgctaggtgttggggaaactcagtgccgcagttaacacaataagcattccgcctggggagtacgaccgcaaggttgaaactcaaaggaattgacggggacccgcacaagcagcggagcatgtggtttaattcgaagcaacgcgaagaaccttaccaggtcttgacatcctctgacaatcccagagatgggacgtttccttcgggaacagagagacaggtggtgcatggttgtcgtcagctcgtgtcgtgagatgttgggttaagtcccgcaacgagcgcaacccctgcctttagttgccagcattgagttgggcactctagagggactgccgtagacaatacggaggaaggtggggatgacgtcaaatcatcatgccccttatgacctgggctacacacgtgctacaatggtctgaacagagggccgcgaaaccgcgaggtgaagcaaatcccttaaaacagatcccagttcggattgcaggctgcaactcgcctgcatgaagttggagttgctagtaatcgcggatcagaatgccgcggtgaatgcgttcccgggtcttgtacacaccgcccgtcacaccacgagagttggcaacacccgaagcccgtgagagaaccgtaaggactcagcggtcgaaggtggggctagtaattggggtgaagtcgtaacaaggtagccgtatcggaaggtgcggctggatcacctcctttcta

SEQ ID NO: 3793 - DNA, 1541 bp, Eubacterium plexicaudatum
  ref <308>: DATABASE ACCESSION NUMBER: NCBI ACCESSION: NZ_KB822482.1
  ref <309>: DATABASE ENTRY DATE: 2019-04-01
  ref <313>: RELEVANT RESIDUES IN SEQ ID NO: (1)..(1541)
aacatgagagtttgatcctggctcaggatgaacgctggcggcgtgcttaacacatgcaagtcgaacgaagcatatctgcggaattccttcggggaggaagcagttatgactgagtggcggacgggtgagtaacgcgtgggcaacctgccccataccgggggacaacagccggaaacggctgctaataccgcatacgtttttaaaaccgcatggttttaaaaagaaaactccggtggtatgggatgggcccgcgtctgattagctggttggcggggtaacggcccaccaaggcgacgatcagtagccggcctgagagggcggccggccacattgggactgagacacggcccagactcctgcgggaggcagcagtggggaatattgcacaatgggggaaaccctgatgcagcgacgccgcgtgagcgaagaagtacctcggtatgtaaagctctatcagcagggaagaaagtgacagtacctgactaagaagccccggctaactacgtgccagcagccgcggtaatacgtagggggcaagcgttatccggattcactgggcgtaaagggagcgcaggcggcacggcaagtctgatgtgaaagtccggggctcaaccccgggactgcattggaaactgccgggctggagtgtcggaggggtaagcggaattcctagtgtagcggtgaaatgcgtagatattaggaggaacaccagtggcgaaggcggcttactggacgatcactgacgctgaggctcgaaagcgtggggagcaaacaggattagataccctggtagtccacgccgtaaacgatgaatactaggtgtcggcgggcagagcccgccggtgccgcagcaaacgcaataagtattccgcctggggagtacgttcgcaagaatgaaactcaaaggaattgacggggacccgcacaagcggtggagcatgtggtttaattcgaagcaacgcgaagaaccttaccaggccttgacatcccgatgaccaaacatgtaatgtgttttcccttcggggcattggagacaggtggtgcatggttgtcgtcagctcgtgtcgtgagatgttgggttaagtcccgcaacgagcgcaacccctgttcccagtagccagcggatagagccgggcactctggggagactgccggggacaacccggaggaaggcggggacgacgtcaaatcatcatgccccttatggcctgggctacacacgtgctacaatgacgcagacagagggaagcgaagccgcgaggtggagcaaaccccagaaatggcgtctcagttcggactgcagcctgcaactcggctgcacgaagccggaatcgctagtaatcgcagatcagcatgctgcggtgaatacgttcccgggtcttgtacacaccgcccgtcacaccatgggagtcggaaatgcccgaagtcagtggcccaaccgcaaggagggagctgccgaaggcaggtccggtgactggggtgaagtcgtaacaaggtagccgtatcggaaggtgcggctggatcacctcctttctaaggaa

SEQ ID NO: 3794 - DNA, 1542 bp, Eubacterium ramulus
  ref <308>: DATABASE ACCESSION NUMBER: NCBI ACCESSION: NZ_RCYH01000049.1
  ref <309>: DATABASE ENTRY DATE: 2019-04-01
  ref <313>: RELEVANT RESIDUES IN SEQ ID NO: (1)..(1542)
tttttatgagagtttgatcctggctcaggatgaacgctggcggcgtgcttaacacatgcaagtcgaacgaagcactttacctgatttccttcggggatgattgttctgtgactgagtggcggacgggtgagtaacgcgtggataacctgcctcacacagggggataacagttggaaacgactgctaataccgcataagcgcacagcaccgcatggtgcagtgtgaaaaactccggtggtgtgagatggatccgcgtctgattagctggttggcggggtaacggcccaccaaggcgacgatcagtagccggcctgagagggcgaccggccacattgggactgagacacggcccagactcctacgggaggcagcagtggggaatattgcacaatgggggaaaccctgatgcagcgacgccgcgtgagcgatgaagtatttcggtatgtaaagctctatcagcagggaagataatgacggtacctgactaagaagctccggctaaatacgtgccagcagccgcggtaatacgtatggagcaagcgttatccggatttactgggtgtaaagggagcgtaggcggtcctgcaagtctgatgtgaaaggccggggctcaaccccgggactgcattggaaactgtaggactagagtgtcggaggggtaagtggaattcctagtgtagcggtgaaatgcgtagatattaggaggaacaccagtggcgaaggcggcttactggacgactactgacgctgaggctcgaaagcgtggggagcaaacaggattagataccctggtagtccacgccgtaaacgatgaatactaggtgttggcaggcaaggcctgtcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacagaacatgtaatgtgttttcccttcggggcaccggtgacaggtggtgcatggttgtcgtcagctcgtgtcgtgagatgttgggttaagtcccgcaacgagcgcaacccttatccccagtagccagcatttcggatgggcactctgtggagactgccagggacaacctggaggaaggtggggatgacgtcaaatcatcatgccccttatgacttgggctacacacgtgctacaatggcgtaaacaaagggaagcgagaccgcgaggtggagcaaatcccaaaaataacgtcccagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagccggtggcctaaccgcaaggaaggagccgtcgaaggcaggtctgataactggggtgaagtcgtaacaaggtagccgtatcggaaggtgcggctggatcacctcctttctaaggaa

SEQ ID NO: 3795 - DNA, 1263 bp, Eubacterium ruminantium
  ref <308>: DATABASE ACCESSION NUMBER: NCBI ACCESSION: NZ_FUXA01000034.1
  ref <309>: DATABASE ENTRY DATE: 2019-04-01
  ref <313>: RELEVANT RESIDUES IN SEQ ID NO: (1)..(1263)
tttttattgagagttcgatcctggctcaggatgaacgctggcggcgtgcttaacacatgcaagtcgaacggagtacttctcccgagactgaggaagcttgcttctgaagaatcatttgaagtacttagtggcggacgggtgagtaacgcgtgggtaacctgcctcacacagggggataacagttggaaacgactgttaataccgcataagcgcacagtatcgcatgatacagtgtgaaaaactccggtggtgtgagatggacccgcgtctgattagctagttggcgaggtaacggcccaccaaggcgacgatcagtagccggcctgagagggtaaacggccacattgggactgagacacggcccaaactcctacgggaggcagcagtggggaatattgcacaatgggggaaaccctgatgcagcgacgccgcgtgagtgatgaagtatttcggtacgtaaaactctatcagcagggaagaaaatgacggtacctgactaagaagcaccggctaaatacgtgccagcagccgcggtaatacgtatggtgcaagcgttatccggatttactgggtgtaaagggtgcgtaggtggcatggcaagtcagatgtgaaatgccggggctcaaccccggaactgcatttgaaactgtcaagctagagtacaggagaggaaagcggaattcctagtgtagcggtgaaatgcgtagatattaggaggaacaccagtggcgaaggcggctttctggactgacactgacactgaggcacgaaagcgtggggagcaaacaggattagataccctggtagtccacgccgtaaacgatgaatactaggtgttggagagcaaagctcttcggtgccgcagctaacgcattaagtattccacctggggagtacgttcgcaagaataaaactcaaaggaattgacggggacccgcacaagcggtggagcatgtggtttaattcgaagcaacgcgaagaaccttaccaggtcttgacataccgatgacgtctccgtaatgggagagttccttcgggacatcggatacaggtggtgcatggttgtcgtcagctcgtgtcgtgagatgttgggttaagtcccgcaacgagcgcaacccctgttttcagtagccagcatttaggatgggcactctggaaagactgcccgggtcaaccgggaggaaggcggggatgacgtcaaatcatcatgccccttacgatctgggctacacacgtgctacaatggcggtcacaaagggaagc

SEQ ID NO: 3796 - DNA, 1540 bp, Eubacterium sp. 14-2
  ref <308>: DATABASE ACCESSION NUMBER: NCBI ACCESSION: NZ_KE159567.1
  ref <309>: DATABASE ENTRY DATE: 2019-04-01
  ref <313>: RELEVANT RESIDUES IN SEQ ID NO: (1)..(1540)
atgagagtttgatcctggctcaggatgaacgctggcggcgtgcttaacacatgcaagtcgaacgaagcatggcgttggaaatttttcggaatggaagatgccatgactgagtggcggacgggtgagtaacgcgtgggcaacctgccccacacagggggataacagccggaaacggctgctaataccgcataagcgcacagcttcgcatggagcggtgtgaaaagccttcgggcggtgtgggatgggcccgcgtctgattagctggttggcggggcagcggcccaccaaggcgacgatcagtagccggcctgagagggtggacggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgagtaagaagctccggctaaatacgtgccagcagccgcggtaatacgtatggagcaagcgttatccggatttactgggtgtaaagggagcgcaggcggtctggcaagtctgatgtgaaataccggggctcaactccgggactgcattggaaactgtcagactggagtgtcggagaggcaggcggaattcctggtgtagcggtgaaatgcgtagatatcaggaggaacaccagtggcgaaggcggcctgctggacgatgactgacgctgaggctcgaaagcgtggggagcaaacaggattagataccctggtagtccacgccgtaaacgatgaataccaggtgtcggggagcagagctcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaggccttgacatcccggtgacagcatatgtaatgtatgttcccttcggggcagcggagacaggtggtgcatggttgtcgtcagctcgtgtcgtgagatgttgggttaagtcccgcaacgagcgcaacccctatccccagtagccagcgggtaaagccgggcactctgtggagactgccagggacaacctggaggaaggtggggatgacgtcaaatcatcatgccccttatggtctgggctacacacgtgctacaatggcgtaaacagagggaagcgagatggtgacatggagcaaatcccaaaaataacgtctcagttcggattgtagtctgcaacccggctacatgaagctggaatcgctagtaatcgcggatcagaatgccgcggtgaatacgttcccgggtcttgtacacaccgcccgtcacaccatgggagtcggaaatgcccgaagtcagtggcccaaccggaaggagggagctgccgaaggcaggttcgatgactggggtgaagtcgtaacaaggtagccgtatcggaaggtgcggctggatcacctcctttctagggaa

SEQ ID NO: 3797 - DNA, 1542 bp, Eubacterium sp. AF15-50
  ref <308>: DATABASE ACCESSION NUMBER: NCBI ACCESSION: NZ_QUHD01000024.1
  ref <309>: DATABASE ENTRY DATE: 2019-04-01
  ref <313>: RELEVANT RESIDUES IN SEQ ID NO: (1)..(1542)
tttaacgagagtttgatcctggctcaggatgaacgctggcggcgtgcttaatacatgcaagtcgaacgaagcacttaagacggacttcttcggaatgaagacttttgtgactgagtggcggacgggtgagtaacgcgtgggtaacctgccttgtacagggggataacagttggaaacgactgctaataccgcataagcgcacagtaccgcatggtacggtgtgaaaaactccggtggtacaagatggacccgcgtctgattagctagttggaggggtaacggcccaccaaggcgacgatcagtagccgacttgagagagtgatcggccacattgggactgagacacggcccaaactcctacgggaggcagcagtagggaatattgcacaatgggggaaaccctgatgcagcgacgccgcgtgaaggatgaagtatttcggtatgtaaacttctatcagcaaggaagataatgacggtacttgactaagaagccccggctaaatacgtgccagcagccgcggtaatacgtatggggcaagcgttatccggatttactgggtgtaaagggagcgtaggcggcatggcaagtcagaagtgaaagcctggggctcaaccccggaattgcttttgaaactgtcaggctagagtgtcggaggggtaagcggaattcctagtgtagcggtgaaatgcgtagatattaggaggaacaccggtggcgaaggcggcttactggacgattactgacgctgaggctcgaaagcgtggggagcaaacaggattagataccctggtagtccacgccgtaaacgatgaatactaggtgtcgggggacaatagttcttcggtgccgaagcaaacgcattaagtattccacctggggagtacgttcgcaagaatgaaactcaaaggaattgacggggacccgcacaagcggtggagcatgtggtttaattcgaagcaacgcgaagaaccttacctgctcttgacatcccggtgaccggacagtaatgtgtccttttcttcggaacaccggtgacaggtggtgcatggttgtcgtcagctcgtgtcgtgagatgttgggttaagtcccgcaacgagcgcaacccttgtctttagtagccagcagttcggctgggcactctagagagactgccagggttaacctggaggaaggcggggatgacgtcaaatcatcatgccccttacgagcagggctacacacgtgctacaatggcgtaaacaaagggaagcgaaagagtgatctggagcaaaccccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggatatgcccgaagtcagtgacccaaccgtaaggagggagctgccgaaggtggagccgataactggggtgaagtcgtaacaaggtagccgtatcggaaggtgcggctggatcacctcctttctaaggaa

SEQ ID NO: 3798 - DNA, 1542 bp, Eubacterium sp. AF16-48
  ref <308>: DATABASE ACCESSION NUMBER: NCBI ACCESSION: NZ_QUHB01000016.1
  ref <309>: DATABASE ENTRY DATE: 2019-04-01
  ref <313>: RELEVANT RESIDUES IN SEQ ID NO: (1)..(1542)
tttaacgagagtttgatcctggctcaggatgaacgctggcggcgtgcttaatacatgcaagtcgaacgaagcacttaagacggacttcttcggaacgaagacttttgtgactgagtggcggacgggtgagtaacgcgtgggtaacctgccttgtacagggggataacagttggaaacgactgctaataccgcataagcgcacagtaccgcatggtacggtgtgaaaaactccggtggtacaagatggacccgcgtctgattagctagttggaggggtaacggcccaccaaggcgacgatcagtagccgacttgagagagtgatcggccacattgggactgagacacggcccaaactcctacgggaggcagcagtagggaatattgcacaatgggggaaaccctgatgcagcgacgccgcgtgaaggatgaagtatttcggtatgtaaacttctatcagcaaggaagataatgacggtacttgactaagaagccccggctaaatacgtgccagcagccgcggtaatacgtatggggcaagcgttatccggatttactgggtgtaaagggagcgtaggcggcatggcaagtcagaagtgaaagcctggggctcaaccccggaattgcttttgaaactgtcaggctagagtgtcggaggggtaagcggaattcctagtgtagcggtgaaatgcgtagatattaggaggaacaccggtggcgaaggcggcttactggacgattactgacgctgaggctcgaaagcgtggggagcaaacaggattagataccctggtagtccacgccgtaaacgatgaatactaggtgtcgggggacaatagttcttcggtgccgaagcaaacgcattaagtattccacctggggagtacgttcgcaagaatgaaactcaaaggaattgacggggacccgcacaagcggtggagcatgtggtttaattcgaagcaacgcgaagaaccttacctgctcttgacatcccggtgaccggacagtaatgtgtccttttcttcggaacaccggtgacaggtggtgcatggttgtcgtcagctcgtgtcgtgagatgttgggttaagtcccgcaacgagcgcaacccttgtctttagtagccagcagttcggctgggcactctagagagactgccagggttaacctggaggaaggcggggatgacgtcaaatcatcatgccccttacgagcagggctacacacgtgctacaatggcgtaaacaaagggaagcgaaagagtgatctggagcaaaccccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggatatgcccgaagtcagtgacccaaccgtaaggagggagctgccgaaggtggagccgataactggggtgaagtcgtaacaaggtagccgtatcggaaggtgcggctggatcacctcctttctaaggaa

SEQ ID NO: 3799 - DNA, 1541 bp, Eubacterium sp. AF18-3
  ref <308>: DATABASE ACCESSION NUMBER: NCBI ACCESSION: NZ_QVGV01000024.1
  ref <309>: DATABASE ENTRY DATE: 2019-04-01
  ref <313>: RELEVANT RESIDUES IN SEQ ID NO: (1)..(1541)
caaatggagagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaagttggggactcaggagagactgccggtgacaaaccggaggaaggtggggatgacgtcaaatcatcatgccccttatggcctgggctacacacgtactacaatggcgcctacaaagagcagcgacaccgcgaggtgaagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctcctttcta

SEQ ID NO: 3800 - DNA, 1385 bp, Eubacterium sp. AF19-12LB
  ref <308>: DATABASE ACCESSION NUMBER: NCBI ACCESSION: NZ_QUGP01000033.1
  ref <309>: DATABASE ENTRY DATE: 2019-04-01
  ref <313>: RELEVANT RESIDUES IN SEQ ID NO: (1)..(1385)
gggggacaacagttggaaacgactgctaataccgcataagcgcacagcatcgcatgatgcagtgtgaaaaactccggtggtacaggatggacccgcgtctgattagctagttggtgaggtaacggcttaccaaggcaacgatcagtagccgacttgagagagtgatcggccacattgggactgagacacggcccaaactcctacgggaggcagcagtggggaatattgcacaatgggggaaaccctgatgcagcgacgccgcgtgaaggaagaagtatttcggtatgtaaacttctatcagcaaggaagaaaatgacggtacttgactaagaagccccggctaaatacgtgccagcagccgcggtaatacgtatggggcaagcgttatccggatttactgggtgtaaagggagcgtaggcggtaagacaagtcagaagtgaaaggctggggctcaaccctgggactgcttttgaaactgtctaactagagtgcaggagaggtaagtggaattcctagtgtagcggtgaaatgcgtagatattaggaggaacaccagtggcgaaggcggcttactggactgtaactgacgctgaggctcgaaagcgtggggagcaaacaggattagataccctggtagtccacgccgtaaacgatgaatactaggtgttggggaacaatagttcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttacctgctcttgacatcccactgaccggtcagtaatgtgaccttttcttcggaacagtggagacaggtggtgcatggttgtcgtcagctcgtgtcgtgagatgttgggttaagtcccgcaacgagcgcaacccttatctttagtagccagcatttcggatgggcactctagagagactgccagggataacctggaggaaggtggggatgacgtcaaatcatcatgccccttatgagcagggctacacacgtgctacaatggcgtaaacaaagggaagcgagaccgtgaggtggagccaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggatatgcccgaagtcagtgacccaaccgtaaggagggagctgccgaaggtggagccgataactggggtgaagtcgtaacaaggtagccgtatcggaaggtgcggctggatcacctcctttctaaggaa

SEQ ID NO: 3801 - DNA, 1541 bp, Eubacterium sp. AF19-17
  ref <308>: DATABASE ACCESSION NUMBER: NCBI ACCESSION: NZ_QVGU01000019.1
  ref <309>: DATABASE ENTRY DATE: 2019-04-01
  ref <313>: RELEVANT RESIDUES IN SEQ ID NO: (1)..(1541)
caaatggagagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaggttggggactcaggagagactgccggtgacaaaccggaggaaggtggggatgacgtcaaatcatcatgccccttatggcctgggctacacacgtactacaatggcgcctacaaagagcagcgacaccgcgaggtggagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctcctttcta

SEQ ID NO: 3802 - DNA, 1550 bp, Eubacterium sp. AF22-8LB
  ref <308>: DATABASE ACCESSION NUMBER: NCBI ACCESSION: NZ_QRVI01000014.1
  ref <309>: DATABASE ENTRY DATE: 2019-04-01
  ref <313>: RELEVANT RESIDUES IN SEQ ID NO: (1)..(1550)
caaatggagagtttgatcctggctcaggatgaacgctggcggcatgcctaatacatgcaagtcgaacgagaggaaggaaagcttgcttttctgaatctagtggcgaacgggtgagtaacacgtaggtaacctgcccatgtgcccgggataacttctggaaacggatgctaaaaccggataggtagcagacaagcatttgactgctattaaagtggctatggccatgaacatggatggacctgcggtgcattagctagttggtgaggtaacggcccaccaaggcgacgatgcatagccggcctgagagggcggacggccacattgggactgagacacggcccaaactcctacgggaggcagcagtagggaattttcgtcaatggggggaaccctgaacgagcaatgccgcgtgagtgaggaaggtcttcggatcgtaaagctctgttgtaagagaaaaacggcactcatagggaatgatgagtgagtgatggtatcttaccagaaagtcacggctaactacgtgccagcagccgcggtaatacgtaggtggcgagcgttatccggaatgattgggcgtaaagggtgcgtaggtggcagatcaagtctggagtaaaaggtatgggctcaacccgtactggctctggaaactgatcagctagagaacagaagaggacggcggaactccatgtgtagcggtaaaatgcgtagatatatggaagaacaccggtggcgaaggcggccgtctggtctggattctgacactgaagcacgaaagcgtggggagcaaataggattagataccctagtagtccacgccgtaaacgatgagaactaggtgttgggggaataactcagtgccgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatcccttgcagaggtatagagatatatccgaggttaacaaggagacaggtggtgcatggttgtcgtcagctcgtgtcgtgagatgttgggttaagtcccgcaacgagcgcaacccttgtgatatgttactaacattgagttgaggactcatatcagactgccggtgataaaccggaggaaggtggggatgacgtcaaatcatcatgccccttatggcctgggctacacacgtactacaatggcgtctacaaagagcggcaagcctgtgaaggcaagcgaatctcataaaggacgtctcagttcggattgaagtctgcaacccgacttcatgaagctggaatcgctagtaatcgcgaatcagcatgtcgcggtgaatacgttctcgggccttgtacacaccgcccgtcaaaccatgggagttggtaatgcccgaagccggtggcataacccttcggggagtgagccgtcgaaggcaggaccgatgactggggttaagtcgtaacaaggtatccctacgggaacgtggggatggatcacctcctttctaaggaga

SEQ ID NO: 3803 - DNA, 1539 bp, Eubacterium sp. AF22-9
  ref <308>: DATABASE ACCESSION NUMBER: NCBI ACCESSION: NZ_QRVH01000128.1
  ref <309>: DATABASE ENTRY DATE: 2019-04-01
  ref <313>: RELEVANT RESIDUES IN SEQ ID NO: (1)..(1539)
tttttatgagagtttgatcctggctcaggatgaacgctggcggcgtgcttaacacatgcaagtcgaacgaagcatttacgacagatttcttcggattgaagttgtttatgactgagtggcggacgggtgagtaacgcgtgggtaacctgccttgtactgggggatagcagctggaaacggctggtaataccgcataagcgcacaatgttgcatgacatggtgtgaaaaactccggtggtataagatggacccgcgtctgattagctagttggtgagataacagcccaccaaggcgacgatcagtagccgacctgagagggtgaccggccacattgggactgagacacggcccagactcctacgggaggcagcagtggggaatattgcacaatggaggaaactctgatgcagcgacgccgcgtgagtgaagaagtaattcgttatgtaaagctctatcagcagggaagatagtgacggtacctgactaagaagctccggctaaatacgtgccagcagccgcggtaatacgtatggagcaagcgttatccggatttactgggtgtaaagggagtgtaggtggccatgcaagtcagaagtgaaaatccggggctcaaccccggaactgcttttgaaactgtaaggctggagtgcaggaggggtgagtggaattcctagtgtagcggtgaaatgcgtagatattaggaggaacaccagtggcgaaggcggctcactggactgtaactgacactgaggctcgaaagcgtggggagcaaacaggattagataccctggtagtccacgccgtaaacgatgaatactaggtgtcggggcccataagggcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccggacagtaatgtgtcctttccttcgggacagtggtgacaggtggtgcatggttgtcgtcagctcgtgtcgtgagatgttgggttaagtcccgcaacgagcgcaacccctatccttagtagccagcagtaagatgggcactctagggagactgccagggataacctggaggaaggtggggatgacgtcaaatcatcatgccccttatgacttgggctacacacgtgctacaatggcgtaaacaaagtgaagcgaagtcgtgaggccaagcaaatcacaaaaataacgtctcagttcggattgtagtctgcaactcgactacatgaagctggaatcgctagtaatcgcagacagaatgctgcggtgaatacgttcccgggtcttgtacacaccgcccgtcacaccatgggagtcgaaaatgcccgaagtcggtgacctaacgtaagaaggagccgccgaaggcaggtttgataactggggtgaagtcgtaacaaggtagccgtatcggaaggtgcggctggatcacctcctttctaaggaa

SEQ ID NO: 3804 - DNA, 1556 bp, Eubacterium sp. AF36-5BH
  ref <308>: DATABASE ACCESSION NUMBER: NCBI ACCESSION: NZ_QTVG01000004.1
  ref <309>: DATABASE ENTRY DATE: 2019-04-01
  ref <313>: RELEVANT RESIDUES IN SEQ ID NO: (1)..(1556)
tttaacgagagtttgatcctggctcaggatgaacgctggcggcgtgcttaatacatgcaagtcgaacgaagcacctctcccgaagatagacccagcttgctgggaattgattcacctgaggtgactgagtggcggacgggtgagtaacgcgtgggtaacctgccttatacagggggataacagttggaaacgactgctaataccgcataagcgcacagtaccgcatggtacagtgtgaaaaactccggtggtataagatggacccgcgtctgattagctagttggtgaggtaacggcttaccaaggcaacgatcagtagccgacttgagagagtgatcggccacattgggactgagacacggcccaaactcctacgggaggcagcagtagggaatattgcacaatgggggaaaccctgatgcagcgacgccgcgtgaaggatgaagtatttcggtatgtaaacttctatcagcaaggaagaaaatgacggtacttgactaagaagccccggctaaatacgtgccagcagccgcggtaatacgtatggggcaagcgttatccggatttactgggtgtaaagggagcgtaggcggtatggcaagtcagaagtgaaagcctggggctcaaccccggaattgcttttgaaactgtcaaactagagtgtcggaggggtaagcggaattcctagtgtagcggtgaaatgcgtagatattaggaggaacaccggtggcgaaggcggcttactggacgaccactgacgctgaggctcgaaagcgtggggagcaaacaggattagataccctggtagtccacgccgtaaacgatgaatactaggtgtcggggaacaatagttcttcggtgccgcagctaacgcattaagtattccacctggggagtacgttcgcaagaatgaaactcaaaggaattgacggggacccgcacaagcggtggagcatgtggtttaattcgaagcaacgcgaagaaccttacctgctcttgacatcccactgacaggtcagtaatgtgaccctttcttcggaacagtggtgacaggtggtgcatggttgtcgtcagctcgtgtcgtgagatgttgggttaagtcccgcaacgagcgcaacccttgtctttagtagccagcagttcggctgggcactctagagagactgccagggataacctggaggaaggcggggatgacgtcaaatcatcatgccccttacgagcagggctacacacgtgctacaatggcgtaaacaaagggaagcgaccccgtgagggtgagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggatatgcccgaagtcagtgacccaaccatatggagggagctgccgaaggtggagccgataactggggtgaagtcgtaacaaggtagccgtatcggaaggtgcggctggatcacctcctttctaaggaa

SEQ ID NO: 3805 - DNA, 1531 bp, Eubacterium sp. AM05-23
  ref <308>: DATABASE ACCESSION NUMBER: NCBI ACCESSION: NZ_QUDF01000006.1
  ref <309>: DATABASE ENTRY DATE: 2019-04-01
  ref <313>: RELEVANT RESIDUES IN SEQ ID NO: (1)..(1531)
tttattgagagtttgatcctggctcaggacgaacgctggcggtatgcttaacacatgcaagtcgaacgagaagatcagttaagaaccttcgggggaataagtgattggaaagtggcgaacgggtgagtaacgcgtgggtaacctgccctatggaaaggaatagcctcgggaaactgggagtaaagccttatattatggagagatcgcatggtcatttcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaagaatgacggtacccaatgaggaagtcccggctaactacgtgccagcagccgcggtaatacgtaggggacaagcgttgtccggaatgactgggcgtaaagggcgcgtaggcggtctgataagtcagatgtgaaaggtaccggctcaaccggtgacgtgcatttgaaactgtcagacttgagtattggagaggcaagtggaattcctagtgtagcggtgaaatgcgtagatattaggaggaacaccagtggcgaaggcggcttgctggacaaatactgacgctgaggtgcgaaagcgtggggagcgaacaggattagataccctggtagtccacgccgtaaacgatgaatgctaggtgttggggaaactcagtgccgcagttaacacaataagcattccgcctggggagtacgaccgcaaggttgaaactcaaaggaattgacggggacccgcacaagcagcggagcatgtggtttaattcgaagcaacgcgaagaaccttaccaggtcttgacatcctctgacaatcccagagatgggacgtttccttcgggaacagagagacaggtggtgcatggttgtcgtcagctcgtgtcgtgagatgttgggttaagtcccgcaacgagcgcaacccctgcctttagttgccagcattgagttgggcactctagagggactgccgtagacaatacggaggaaggtggggatgacgtcaaatcatcatgccccttatgacctgggctacacacgtgctacaatggtctgaacagagggccgcgaaaccgcgaggtgaagcaaatcccttaaaacagatcccagttcggattgcaggctgcaactcgcctgcatgaagttggagttgctagtaatcgcggatcagaatgccgcggtgaatgcgttcccgggtcttgtacacaccgcccgtcacaccacgagagttggcaacacccgaagcccgtgagagaaccgtaaggactcagcggtcgaaggtggggctagtaattggggtgaagtcgtaacaaggtagccgtatcggaaggtgcggctggatcacctcctttctagggaa

SEQ ID NO: 3806 - DNA, 1548 bp, Eubacterium sp. AM18-10LB-B
  ref <308>: DATABASE ACCESSION NUMBER: NCBI ACCESSION: NZ_QUCT01000024.1
  ref <309>: DATABASE ENTRY DATE: 2019-04-01
  ref <313>: RELEVANT RESIDUES IN SEQ ID NO: (1)..(1548)
caaatggagagtttgatcctggctcaggatgaacgctggcggcatgcctaatacatgcaagtcgaacggagcgaatatggaagcttgcttccgtaagagctcagtggcgaacgggtgagtaacacgtaggtaacctgcccatgtgcccgggataactgctggaaacggtagctaaaaccggataggtgaataggaggcatctcttattcattaaaggacctgtaaaggtgcgaacatggatggacctgcggcgcattagctggttggagtggtaacggcacaccaaggcgacgatgcgtagccgacctgagagggcgaacggccacattgggactgagacacggcccaaactcctacgggaggcagcagtagggaattttcgtcaatggggggaaccctgaacgagcaatgccgcgtgagtgaagaaggtcttcggatcgtaaagctctgttgtaagtgaagaacggtcagtagaggaaatgatactgaagtgacggtagcttaccagaaagccacggctaactacgtgccagcagccgcggtaatacgtaggtggcgagcgttatccggaatcattgggcgtaaagggtgcgcaggtggtacattaagtccgaagtaaaaggcagcagctcaactgctgttggctttggaaactggtgaactggagtgcaggagagggcgatggaattccatgtgtagcggtaaaatgcgtagatatatggaggaacaccagtggcgaaggcggtcgcctggcctgcaactgacactgaggcacgaaagcgtggggagcaaataggattagataccctagtagtccacgccgtaaacgatgagaactaagtgttggggagactcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatgtaaatgttctagagatagaaagatagctatacatcacacaggtggtgcatggttgtcgtcagctcgtgtcgtgagatgttgggttaagtcccgcaacgagcgcaacccttgtcgcatgttaccagtattgagttagggactcatgcgagactgccggtgacaaaccggaggaaggtggggatgacgtcaaatcatcatgccccttatggcctgggctacacacgtactacaatggcggctacaaagagaagcgaacctgcgagggggagcggaactcataaaggccgtctcagttcggattggagtctgcaactcgactccatgaagtcggaatcgctagtaatcgcagatcagcatgctgcggtgaatacgttctcgggccttgtacacaccgcccgtcaaaccatgggagttggtaatacccgaagccggtggcataaccgtgaggagtgagccgtcgaaggtaggaccgatgactggggttaagtcgtaacaaggtatccctacgggaacgtggggatggatcacctcctttctaagga

SEQ ID NO: 3807 - DNA, 1548 bp, Eubacterium sp. AM28-29
  ref <308>: DATABASE ACCESSION NUMBER: NCBI ACCESSION: NZ_QSKE01000025.1
  ref <309>: DATABASE ENTRY DATE: 2019-04-01
  ref <313>: RELEVANT RESIDUES IN SEQ ID NO: (1)..(1548)
caaatggagagtttgatcctggctcaggatgaacgctggcggcatgcctaatacatgcaagtcgaacgagaggaaggaaagcttgctttcctgaatctagtggcgaacgggtgagtaacacgtaggtaacctgcccatgtgcccgggataacttctggaaacggatgctaaaaccggataggtagcagacaagcatttgactgctattaaagtggccttggccatgaacatggatggacctgcggtgcattagctagttggtgaggtaacggcccaccaaggcgacgatgcatagccggcctgagagggcggacggccacattgggactgagacacggcccaaactcctacgggaggcagcagtagggaattttcgtcaatggggggaaccctgaacgagcaatgccgcgtgagtgaggaaggtcttcggatcgtaaagctctgttgtaagagaaaaacggcactcatagggaatgatgagtgagtgatggtatcttaccagaaagtcacggctaactacgtgccagcagccgcggtaatacgtaggtggcgagcgttatccggaatgattgggcgtaaagggtgcgtaggtggcagatcaagtctggagtaaaaggtatgggctcaacccgtactggctctggaaactgatcagctagagaacagaagaggacggcggaactccatgtgtagcggtaaaatgcgtagatatatggaagaacaccggtggcgaaggcggccgtctggtctggattctgacactgaagcacgaaagcgtggggagcaaataggattagataccctagtagtccacgccgtaaacgatgagaactaggtgttgggggaataactcagtgccgcagttaacgcagtaagttctccgcctggggagtatgcacgcaagtgtgaaactcaaaggaattgacgggggcccgcacaagcggtggagtatgtggtttaattcgaagcaacgcgaagaaccttaccaggccttgacatcccttgcagaggtatagagatatatccgaggttatcaaggagacaggtggtgcatggttgtcgtcagctcgtgtcgtgagatgttgggttaagtcccgcaacgagcgcaacccttgtgatatgttactaacattgagttgaggactcatatcagactgccggtgataaaccggaggaaggtggggatgacgtcaaatcatcatgccccttatggcctgggctacacacgtactacaatggcgtctacaaagagcggcaagcctgtgaaggcaagcgaatctcataaaggacgtctcagttcggattgaagtctgcaacccgacttcatgaagctggaatcgctagtaatcgcgaatcagcatgtcgcggtgaatacgttctcgggccttgtacacaccgcccgtcaaaccatgggagttggtaatgcccgaagccggtggcataacccttcggggagtgagccgtcgaaggcaggaccgatgactggggttaagtcgtaacaaggtatccctacgggaacgtggggatggatcacctcctttctaagga

SEQ ID NO: 3808 - DNA, 1541 bp, Eubacterium sp. AM28-8LB
  ref <308>: DATABASE ACCESSION NUMBER: NCBI ACCESSION: NZ_QVHC01000012.1
  ref <309>: DATABASE ENTRY DATE: 2019-04-01
  ref <313>: RELEVANT RESIDUES IN SEQ ID NO: (1)..(1541)
caaatggagagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaagttggggactcaggagagactgccggtgacaaaccggaggaaggtggggatgacgtcaaatcatcatgccccttatggcctgggctacacacgtactacaatggcgcctacaaagagcagcgacaccgcgaggtggagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctcctttcta

SEQ ID NO: 3809 - DNA, 1540 bp, Eubacterium sp. AM35-6AC
  ref <308>: DATABASE ACCESSION NUMBER: NCBI ACCESSION: NZ_QVHB01000055.1
  ref <309>: DATABASE ENTRY DATE: 2019-04-01
  ref <313>: RELEVANT RESIDUES IN SEQ ID NO: (1)..(1540)
caaatggagagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcacctcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaggttggggactcaggagagactgccggtgacaaaccggaggaaggtggggatgacgtcaaatcatcatgccccttatggcctgggctacacacgtactacaatggcgcctacaaagagcagcgacaccgcgaggtggagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctcctttcta

SEQ ID NO: 3810 - DNA, 1540 bp, Eubacterium sp. AM47-9
  ref <308>: DATABASE ACCESSION NUMBER: NCBI ACCESSION: NZ_QVGQ01000068.1
  ref <309>: DATABASE ENTRY DATE: 2019-04-01
  ref <313>: RELEVANT RESIDUES IN SEQ ID NO: (1)..(1540)
caaatggagagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcacctcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtgaagaaggtcttcggatcgtaaagcactgttgtaagtgaagaatgccatatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaagttggggactcaggagagactgccggtgacaaaccggaggaaggtggggatgacgtcaaatcatcatgccccttatggcctgggctacacacgtactacaatggcgcctacaaagagcagcgacaccgcgaggtggagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctcctttcta

SEQ ID NO: 3811 - DNA, 1550 bp, Eubacterium sp. Marseille-P5640
  ref <308>: DATABASE ACCESSION NUMBER: NCBI ACCESSION: NZ_LS990884.1
  ref <309>: DATABASE ENTRY DATE: 2019-04-01
  ref <313>: RELEVANT RESIDUES IN SEQ ID NO: (1)..(1550)
caaatggagagtttgatcctggctcaggatgaacgctggcggcatgcctaatacatgcaagtcgaacggagcgaatatggaagcttgcttccgtaagagctcagtggcgaacgggtgagtaacacgtaggtaacctgcccatgtgcccgggataactgctggaaacggtagctaaaaccggataggtgaataggaggcatctcttattcattaaaggacctttaaaggtgcgaacatggatggacctgcggcgcattagctggttggagtggtaacggcacaccaaggcgacgatgcgtagccgacctgagagggcgaacggccacattgggactgagacacggcccaaactcctacgggaggcagcagtagggaattttcgtcaatggggggaaccctgaacgagcaatgccgcgtgagtgaagaaggtcttcggatcgtaaagctctgttgtaagtgaagaacggtcagtagaggaaatgatactgaagtgacggtagcttaccagaaagccacggctaactacgtgccagcagccgcggtaatacgtaggtggcgagcgttatccggaatcattgggcgtaaagggtgcgcaggtggtacattaagtccgaagtaaaaggcagcagctcaactgctgttggctttggaaactggtgaactggagtgcaggagagggcgatggaattccatgtgtagcggtaaaatgcgtagatatatggaggaacaccagtggcgaaggcggtcgcctggcctgcaactgacactgaggcacgaaagcgtggggagcaaataggattagataccctagtagtccacgccgtaaacgatgagaactaagtgttggggagactcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatgtaaatgccctagagatagggagataggtatacatcacacaggtggtgcatggttgtcgtcagctcgtgtcgtgagatgttgggttaagtcccgcaacgagcgcaacccttgtcgcatgttaccagtattgagttagggactcatgcgagactgccggtgacaaaccggaggaaggtggggatgacgtcaaatcatcatgccccttatggcctgggctacacacgtactacaatggcggctacaaagagaagcgaacctgcgagggggagcggaactcataaaggtcgtctcagttcggattggagtctgcaactcgactccatgaagtcggaatcgctagtaatcgcagatcagcatgctgcggtgaatacgttctcgggccttgtacacaccgcccgtcaaaccatgggagttggtaatacccgaagccggtggcataaccttagggagtgagccgtcgaaggtaggaccgatgactggggttaagtcgtaacaaggtatccctacgggaacgtggggatggatcacctcctttctaaggaga

SEQ ID NO: 3812 - DNA, 1540 bp, Eubacterium sp. OF10-16; identical to SEQ ID NO: 3809
  ref <308>: DATABASE ACCESSION NUMBER: NCBI ACCESSION: NZ_QVHP01000049.1
  ref <309>: DATABASE ENTRY DATE: 2019-04-01
  ref <313>: RELEVANT RESIDUES IN SEQ ID NO: (1)..(1540)

SEQ ID NO: 3813 - DNA, 1541 bp, Eubacterium sp. OM08-24
  ref <308>: DATABASE ACCESSION NUMBER: NCBI ACCESSION: NZ_QSTA01000002.1
  ref <309>: DATABASE ENTRY DATE: 2019-04-01
  ref <313>: RELEVANT RESIDUES IN SEQ ID NO: (1)..(1541)
aaattttagagagtttgatcctggctcaggacgaacgctggcggcgtgcctaacacatgcaagtcgaacggaacttctttaattgatttcttcggaatgattttgattaagtttagtggcggacgggtgagtaacgcgtgagtaacctgcctctgagaggggaataacattctgaaaagaatgctaataccgcataatatatatttatcgcatgatagatatatcaaagatttatcgctcagagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggtcttcggattgtaaacttcttttattaaggacgaataaagtgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccatagcctgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcctactaacgagatagagatatgttaggtgcccttcggggaaagtagagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggacattaacagagggaagcaatacagcgatgtggagcaaacccctaaaaatgttctcagttcagattgcaggctgcaacccgcctgtatgaagatggaattgctagtaatcgcagatcagcatgctgcggtgaatacgttcccgggccttgtacacaccgcccgtcacaccatgggagccggtaatacccgaagtcagtagtctaaccgcaaggaggacgctgccgaaggtaggattggcgactggggtgaagtcgtaacaaggtagccgtatcggaaggtgcggctggatcacctcctttctatgga

SEQ ID NO: 3814 - DNA, 1541 bp, Eubacterium sp. SB2
  ref <308>: DATABASE ACCESSION NUMBER: NCBI ACCESSION: NZ_LN865149.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcttaacacatgcaagtcgagcgaagcgctttacttagatttcttcggattgaagagttttgcgactgagcggcggacgggtgagtaacgcgtgggtaacctgcctcatacagggggataacagttagaaatgactgctaataccgcataagaccacggtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 3815 - DNA, 1541 bp, Eubacterium sp. TF05-29; identical to SEQ ID NO: 3808
  ref <308>: DATABASE ACCESSION NUMBER: NCBI ACCESSION: NZ_QVHK01000019.1
  ref <309>: DATABASE ENTRY DATE: 2019-04-01
  ref <313>: RELEVANT RESIDUES IN SEQ ID NO: (1)..(1541)

SEQ ID NO: 3816 - DNA, 1541 bp, Eubacterium sp. TF12-12; identical to SEQ ID NO: 3808
  ref <308>: DATABASE ACCESSION NUMBER: NCBI ACCESSION: NZ_QVHH01000047.1
  ref <309>: DATABASE ENTRY DATE: 2019-04-01
  ref <313>: RELEVANT RESIDUES IN SEQ ID NO: (1)..(1541)

SEQ ID NO: 3817 - DNA, 1548 bp, Eubacterium sp. TM05-53
  ref <308>: DATABASE ACCESSION NUMBER: NCBI ACCESSION: NZ_QSPK01000016.1
  ref <309>: DATABASE ENTRY DATE: 2019-04-01
  ref <313>: RELEVANT RESIDUES IN SEQ ID NO: (1)..(1548)
caaatggagagtttgatcctggctcaggatgaacgctggcggcatgcctaatacatgcaagtcgaacgagaggaaggaaagcttgcttttctgaatctagtggcgaacgggtgagtaacacgtaggtaacctgcccatgtgcccgggataacttctggaaacggatgctaaaaccggataggtagcagacaagcatttgactgctattaaagtggctttggccatgaacatggatggacctgcggtgcattagctagttggtgaggtaacggcccaccaaggcgacgatgcatagccggcctgagagggcggacggccacattgggactgagacacggcccaaactcctacgggaggcagcagtagggaattttcgtcaatggggggaaccctgaacgagcaatgccgcgtgagtgaggaaggtcttcggatcgtaaagctctgttgtaagagaaaaacggcactcatagggaatgatgagtgagtgatggtatcttaccagaaagtcacggctaactacgtgccagcagccgcggtaatacgtaggtggcgagcgttatccggaatgattgggcgtaaagggtgcgtaggtggcagatcaagtctggagtaaaaggtatgggctcaacccgtactggctctggaaactgatcagctagagaacagaagaggacggcggaactccatgtgtagcggtaaaatgcgtagatatatggaagaacaccggtggcgaaggcggccgtctggtctggatactgacactgaagcacgaaagcgtggggagcaaataggattagataccctagtagtccacgccgtaaacgatgagaactaggtgttgggggaataactcagtgccgcagttaacgcagtaagttctccgcctggggagtatgcacgcaagtgtgaaactcaaaggaattgacgggggcccgcacaagcggtggagtatgtggtttaattcgaagcaacgcgaagaaccttaccaggccttgacatcccttgcagaggtatagagatatatccgaggttatcaaggagacaggtggtgcatggttgtcgtcagctcgtgtcgtgagatgttgggttaagtcccgcaacgagcgcaacccttgtgatatgttactaacattgagttgaggactcatatcagactgccggtgataaaccggaggaaggtggggatgacgtcaaatcatcatgccccttatggcctgggctacacacgtactacaatggcgtctacaaagagcggcaagcctgtgaaggcaagcgaatctcataaaggacgtctcagttcggattgaagtctgcaacccgacttcatgaagctggaatcgctagtaatcgcgaatcagcatgtcgcggtgaatacgttctcgggccttgtacacaccgcccgtcaaaccatgggagttggtaatgcccgaagccggtggcataacctttcgaggagtgagccgtcgaaggcaggaccgatgactggggttaagtcgtaacaaggtatccctacgggaacgtggggatggatcacctcctttctaagga

SEQ ID NO: 3818 - DNA, 1548 bp, Eubacterium sp. TM06-47
  ref <308>: DATABASE ACCESSION NUMBER: NCBI ACCESSION: NZ_QSPB01000099.1
  ref <309>: DATABASE ENTRY DATE: 2019-04-01
  ref <313>: RELEVANT RESIDUES IN SEQ ID NO: (1)..(1548)
caaatggagagtttgatcctggctcaggatgaacgctggcggcatgcctaatacatgcaagtcgaacgagaggaaggaaagcttgctttcctaaatctagtggcgaacgggtgagtaacacgtaggtaacctgcccatgtgcccgggataacttctggaaacggatgctaaaaccggataggtagcagacaagcatttgactgctattaaagtggctaaggccatgaacatggatggacctgcggtgcattagctagttggtgaggtaacggcccaccaaggcgacgatgcatagccggcctgagagggcggacggccacattgggactgagacacggcccaaactcctacgggaggcagcagtagggaattttcgtcaatggggggaaccctgaacgagcaatgccgcgtgagtgaggaaggtcttcggatcgtaaagctctgttgtaagagaaaaacggcactcatagggaatgatgagtgagtgatggtatcttaccagaaagtcacggctaactacgtgccagcagccgcggtaatacgtaggtggcgagcgttatccggaatgattgggcgtaaagggtgcgtaggtggcagatcaagtctggagtaaaaggtatgggctcaacccgtacttgctctggaaactgatcagctagagaacagaagaggacggcggaactccatgtgtagcggtaaaatgcgtagatatatggaagaacaccggtggcgaaggcggccgtctggtctggattctgacactgaagcacgaaagcgtggggagcaaataggattagataccctagtagtccacgccgtaaacgatgagaactaggtgttgggggaataactcagtgccgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatcccttgcagaggtatagagatatatccgaggttatcaaggagacaggtggtgcatggttgtcgtcagctcgtgtcgtgagatgttgggttaagtcccgcaacgagcgcaacccttgtgatatgttactaacattgagttgaggactcatatcagactgccggtgataaaccggaggaaggtggggatgacgtcaaatcatcatgccccttatggcctgggctacacacgtactacaatggcgtctacaaagagcggcaagcctgtgaaggcaagcgaatctcataaaggacgtctcagttcggattgaagtctgcaacccgacttcatgaagctggaatcgctagtaatcgcgaatcagcatgtcgcggtgaatacgttctcgggccttgtacacaccgcccgtcaaaccatgggagttggtaatgcccgaagccggtggcataacccttcggggagtgagccgtcgaaggcaggactgatgactggggttaagtcgtaacaaggtatccctacgggaacgtggggatggatcacctcctttctaagga

SEQ ID NO: 3819 - DNA, 1541 bp, Eubacterium sp. am 0171
  ref <308>: DATABASE ACCESSION NUMBER: NCBI ACCESSION: NZ_RCYI01000141.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcttaacacatgcaagtcgagcgaagcgctttacttagatttcttcggattgaaaagttttgcgactgagcggcggacgggtgagtaacgcgtgggtaacctgcctcatacagggggataacagttagaaatgactgctaataccgcataagaccacggtgccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgagcagggctacacacgtgctacaatggcgtaaacaaagggaggcaataccgcgaggttgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggcgggatcgataactggggtgaagtcgtaacaaggtagccgtatcggaaggtgcggctggatcacctcctttctaaggaa

SEQ ID NO: 3820 - DNA, 1120 bp, Eubacterium uniforme
  ref <308>: DATABASE ACCESSION NUMBER: NCBI ACCESSION: NZ_FUXZ01000001.1
  ref <309>: DATABASE ENTRY DATE: 2019-04-01
  ref <313>: RELEVANT RESIDUES IN SEQ ID NO: (1)..(1120)
tttaacgagagtttgatcctggctcaggatgaacgctggcggcgtgcttaacacatgcaagtcgaacgaagcactttatttgaaaccttcgggtagattattctgtgacttagtggcggacgggtgagtaacgcgtgggtaacctgcctcatacaccgggataacagttggaaacggctgctaataccggataagcatacagtaccgcatggtacagtgtgaaaaactcaggtggtatgagatggacccgcgtctgattagctagttggtaaggtaacggcttaccaaggcgacgatcagtagccgacttgagagagtgatcggccacattgggactgagacacggcccaaactcctacgggaggcagcagtggggaatattgcacaatgggggaaaccctgatgcagcgacgccgcgtgaaggatgaagtatttcggtatgtaaacttctatcagcaaggaagaaaatgacggtacttgactaagaagccccggctaaatacgtgccagcagccgcggtaatacgtatggggcaagcgttatccggatttactgggtgtaaagggtgcgtaggtggcaaggcaagtcagaagtgaaagctcggggctcaacctcggaactgcttttgaaactgccaggctagagtgcaggagaggtaagtggaattcctagtgtagcggtgaaatgcgtagatattaggaggaacaccagcggcgaaggcggcttactggactgtaactgacactgaggcacgaaagcgtggggagcaaacaggattagataccctggtagtccacgccgtaaacgatgaatactaggtgttggggagcaaagctcttcggtgccgcagctaacgcattaagtattccacctggggagtacgttcgcaagaatgaaactcaaaggaattgacggggacccgcacaagcggtggagcatgtggtttaattcgaagcaacgcgaagaaccttacctgatcttgacatcccgatgcaagactttgtaatgaagtccctcttcggacatcggtgacaggtggtgcatggttgtcgtcagctcgtgtcgtgagatgttgggttaagtcccgcaacgagcgcaacccttatctttagtagccagc

SEQ ID NO: 3821 - DNA, 1542 bp, Eubacterium ventriosum
  ref <308>: DATABASE ACCESSION NUMBER: NCBI ACCESSION: NZ_QROT01000001.1
  ref <309>: DATABASE ENTRY DATE: 2019-04-01
  ref <313>: RELEVANT RESIDUES IN SEQ ID NO: (1)..(1542)
tttaacgagagtttgatcctggctcaggatgaacgctggcggcgtgcttaatacatgcaagtcgaacgaagcaccttggacagaatccttcgggaggaagaccattgtgactgagtggcggacgggtgagtaacgcgtgggtaacctgccttgtacagggggataacagttggaaacgactgctaataccgcataagcgcacagtaccgcatggtacggtgtgaaaaactccggtggtacaagatggacccgcgtctgattagctagttggtgaggtaacggcccaccaaggcgacgatcagtagccgacttgagagagtgatcggccacattgggactgagacacggcccaaactcctacgggaggcagcagtagggaatattgcacaatgggggaaaccctgatgcagcgacgccgcgtgaaggaagaagtatttcggtatgtaaacttctatcagcaaggaagaaaatgacggtacttgactaagaagccccggctaaatacgtgccagcagccgcggtaatacgtatggggcaagcgttatccggatttactgggtgtaaagggagcgtaggcggcatggcaagtcagaagtgaaagcctggggctcaaccccggaattgcttttgaaactgtcaggctagagtgtcggaggggtaagcggaattcctagtgtagcggtgaaatgcgtagatattaggaggaacaccggtggcgaaggcggcttactggacgattactgacgctgaggctcgaaagcgtggggagcaaacaggattagataccctggtagtccacgccgtaaacgatgaatactaggtgtcgggggacaatagttcctcggtgccgaagcaaacgcattaagtattccacctggggagtacgttcgcaagaatgaaactcaaaggaattgacggggacccgcacaagcggtggagcatgtggtttaattcgaagcaacgcgaagaaccttacctgctcttgacatcccactgacaggtcagtaatgtgaccctttcctcggaacagtggagacaggtggtgcatggttgtcgtcagctcgtgtcgtgagatgttgggttaagtcccgcaacgagcgcaacccttgtctttagtagccagcagttcggctgggcactctagagagactgccagggataacctggaggaaggcggggatgacgtcaaatcatcatgccccttacgagcagggctacacacgtgctacaatggcgtaaacaaagggaagcgaccccgtgagggcaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggatatgcccgaagtcagtgacccaaccgtaaggagggagctgccgaaggtggagccgataactggggtgaagtcgtaacaaggtagccgtatcggaaggtgcggctggatcacctcctttctaaggaa

SEQ ID NO: 3822 - DNA, 1467 bp, Euryhalocaulis caribicus
  ref <308>: DATABASE ACCESSION NUMBER: NCBI ACCESSION: NZ_ASJA01000004.1
  ref <309>: DATABASE ENTRY DATE: 2019-04-01
  ref <313>: RELEVANT RESIDUES IN SEQ ID NO: (1)..(1467)
tgagagtttgatcctggctcagaacgaacgctggcggcaggcttaacacatgcaagtcgaacgcactcttcggagtgagtggcagacgggtgagtaacgcgtgggcacctgcccttcagttcggaacaaccgctggaaacggcggctaatgccgaatacgtcctatgggagaaagatttatcgctgaaggatgggcccgcgtcggattagctagttggtggggtaaaagcctaccaaggcgacgatccgtagctggtctgagaggatgaccagccacactgggactgagacacggcccagactcctacgggaggcagcagtggggaatattggacaatgggggaaaccctgatccagccatgccgcgtggatgatgaaggcccttgggttgtaaaatcctttcgctagggaagataatgacggtacctagtaaagaagctccggctaactccgtgccagcagccgcggtaatacggagggggctagcgttgttcggaattactgggcgtaaagcgcgcgtaggcggattgttaagtcgggggtgaaatcccggggccaaccccggaactgccctcgatactggcagtcttgagcccgggagaggcgagtggaattccgagtgtagaggtgaaattcgtagatattcggaggaacaccagtggcgaaggcgactcgctggaccggtgctgacgctgaggcgcgaaagcgtggggagcaaacaggattagataccctggtagtccacgccgtaaacgatgagagctagttgtctggcagcatgctgttaggtgacgcagctaacgcattaagctctccgcctggggagtacggtcgcaagattaaaactcaaaggaattgacgggggcccgcacaagcggtggagcatgtggtttaattcgaagcaacgcgaagaaccttacctgcctttgacatcccaatcgcggtttccagagatggattccttcagttcggctggattggtgacaggtgctgcatggctgtcgtcagctcgtgtcgtgagatgttgggttaagtcccgcaacgagcgcaaccctcactcttagttgccagcaggtttggctgggcactctaagggaactgcccgtggcaagcgggaggaaggtggggatgacgtcaagtcatcatggcccttacaggcagggctacacacgtgctacaatggcagtgacagagagcaaatctctaaaaactgtctcagttcggattgtcttctgcaactcgaaggcatgaagtcggaatcgctagtaatcgcagatcagcatgctgcggtgaatacgttcccgggccttgtacacaccgcccgtcacaccatgggagttggttctacccgaagatggtgcgctaacccgcaagggaggcagccagccacggtagggtcagcgactggggtgaagtcgtaacaaggtagccgtaggggaacctgcggctggatcacctcctttctaa

SEQ ID NO: 3823 - DNA, 1526 bp, Euzebya sp. DY32-46
  ref <308>: DATABASE ACCESSION NUMBER: NCBI ACCESSION: NZ_CP031165.1
  ref <309>: DATABASE ENTRY DATE: 2019-04-01
  ref <313>: RELEVANT RESIDUES IN SEQ ID NO: (1)..(1526)
aatggagagtttgatcctggctcaggacgaacgctggcggcgcgcctaacacatgcaagtcgagggagaagcacatcttcggatgtgtggagaccggcgaacgggtgagtaacacgtgagaaacctaccccggagatgggaataaccacgggaaactgtggctaatgcccaatattctccatttaccgcatggcagctggaggaaaagtccgctgctccgggatggtctcgcggcgtatcagcttgttggtgaggtaatggctcaccaaggcaacgacgcgtagctggagttagagctcgaacagccacactgggactgagacacggcccagactcctacgggaggcagcagtggggaatcttgcgcaatgggcgaaagcctgacgcagcgacgccgcgtgtgggaagaaggccttcgggttgtaaaccactttcaggagggaagaagcgaaagtgacggtacctccagaagaaggtccggccaactacgtgccagcagccgcggtaatacgtagggaccgagcgttgtccggaattattgggcgtaaagagctcgtaggcggttctttaagtcggatgtgaaatctcagggcttaaccctgaaaccgcacccgatactggagaacttgaggcaggtaggggagatcggaattcctggtgtagcggtgaaatgcgcagatatcaggaggaacaccggtggcgaaggcggatctctgggcctgttctgacgctgaggagcgaaagcgtggggagcaaacaggattagataccctggtagtccacgccgtaaacgatgggtgctaggtgtgggagataatccacttcttccgtgccgcagctaacgcattaagcaccccgcctggggactacggccgcaaggctaaaactcaaaggaattgacgggggcccgcacaagcggcggagcatgtggcttaattcgaagcaacgcgaagaaccttaccagggcttgaaatatacggaaaaaccatggaaacatggtgtgcttcggcgtcgtatacaggtggtgcatggttgtcgtcagctcgtgccgtgaggtgttgggttaagtcccgcaacgagcgcaacccttatcctatgttgccagcgcgtaatggcggggactcatgggagactgccggtgtcaaaccggaggaaggtggggacgacgtcaaatcatcatgccccttatgtcctgggctgcacacatgctacaatggccggtacagagggctgcgatcccgcgagggtgagcgaatctcacaaagccggtctcagttcggattggagtctgcaactcgactccatgaaggcggagtcgctagtaatcgcagatcagcaacgctgcggtgaatacgttcccgggccttgtacacaccgcccgtcacgtcatgaaagtcggtaacacccgaagtcagtggcccaaccgcaaggagggagctgccgaaggtgggatcggcgattgggacgaagtcgtaacaaggtagccgtaccggaaggtgcggctggatcacctcctttctaaggag

SEQ ID NO: 3824 - DNA, 1528 bp, Euzebya tangerina
  ref <308>: DATABASE ACCESSION NUMBER: NCBI ACCESSION: NZ_PPDK01000002.1
  ref <309>: DATABASE ENTRY DATE: 2019-04-01
  ref <313>: RELEVANT RESIDUES IN SEQ ID NO: (1)..(1528)
caatggagagtttgatcctggctcaggacgaacgctggcggcgcgccttatacatgcaagtcgagggagaagcatatcttcggatatgtggagaccggcgaacgggtgagtaacacgtgagaaacctaccccggagatcggaataaccacgggaaactgtggctaatgccgaatactctccgcccaccacatggcagacggaggaaaagtccgctgctccgggatggtctcgcggcgtatcagctagttggtgaggtaacggctcaccaaggccacgacgcgtagctggagtgagagctcgaacagccacactgggactgagacacggcccagactcctacgggaggcagcagtagggaatcttgcgcaatgggcgaaagcctgacgcagcgacgccgcgtgtgggaagaaggccttcgggttgtaaaccactttcaggagggaagaagcgaaagtgacggtacctccagaagaagacccggccaactacgtgccagcagccgcggtaatacgtaggggtcaagcgttgtccggaattattgggcgtaaagagctcgtaggcggtcttttaagtcggatgtgaaatctcagggctcaactctgaaactgcatccgatactggaagacttgaggcaggtaggggagatcggaattcctagtgtagcggtgaaatgcgcagatattaggaggaacaccggtggcgaaggcggatctctgggcctgttctgacgctgaggagcgaaagcgtggggagcaaacaggattagataccctggtagtccacgccgtaaacgatgggtgctaggtgtgggagataatccacttcttccgtgccgcagctaacgcattaagcaccccgcctggggactacggccgcaaggctaaaactcaaaggaattgacgggggcccgcacaagcggcggagcatgtggcttaattcgaagcaacgcgaagaaccttaccaaggcttgaaatatacggaaaagctgtggaaacacagtgtgcttcggcgtcgtatacaggtggtgcatggttgtcgtcagctcgtgccgtgaggtgttgggttaagtcccgcaacgagcgcaacccttatcctatgttgccagcgagtaatgtcggggactcatgggagactgccggtgtcaaaccggaggaaggtggggacgacgtcaaatcatcatgccccttatgtcttgggctgcacacatgctacaatggccggtacagagggctgcgatcccgtgagggtgagcgaatctcacaaagccggtctcagttcggattggagtctgcaactcgactccatgaaggcggagtcgctagtaatcgcgaatcagcaatgtcgcggtgaatacgttcccgggccttgtacacaccgcccgtcacgtcatgaaagtcggtaacacccgaagtcagtggcccaactctttgagagggagctgccgaaggtgggatcggcgattgggacgaagtcgtaacaaggtagccgtaccggaaggtgcggctggatcacctcctttctaaggag

SEQ ID NO: 3825 - DNA, 1553 bp, Ewingella americana
  ref <308>: DATABASE ACCESSION NUMBER: NCBI ACCESSION: NZ_UGGO01000001.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcatgacctcgaaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcattaaggttaataaccttagtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtgggggagcaaacaggattagataccctggtagtccacgctgtaaacgatgtcgatttggaggttgtgggcttgacccgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcgagtaatgtcgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 3826 - DNA, 1570 bp, Exiguobacterium acetylicum
  ref <308>: DATABASE ACCESSION NUMBER: NCBI ACCESSION: NZ_LFQN01000019.1
  ref <309>: DATABASE ENTRY DATE: 2019-04-01
  ref <313>: RELEVANT RESIDUES IN SEQ ID NO: (1)..(1570)
ttcatggagagtttgatcctggctcaggacgaacgctggcggcgtgcctaatacatgcaagtcgagcgcaggaaactgacggaactcttcggagggaaggcagtggaatgagcggcggacgggtgagtaacacgtaaggaacctgcctcaaggattgggataactccgagaaatcggagctaataccggatagttcaacggaccgcatggtccgctgatgaaaggcgctccggcgtcaccttgagatggccttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagaggaaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcattgagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3827 - DNA, 1284 bp, Exiguobacterium alkaliphilum
  ref <308>: DATABASE ACCESSION NUMBER: NCBI ACCESSION: NZ_JJMW01000045.1
  ref <309>: DATABASE ENTRY DATE: 2019-04-01
  ref <313>: RELEVANT RESIDUES IN SEQ ID NO: (1)..(1284)
ggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggccctcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggcacagagatgtgccttccccttcgggggcaggggtgacaggtggtgcatggttgtcgtcagctcgtgtcgtgagatgttgggttaagtcccgcaacgagcgcaacccttgtccttagttgccaccattcagttgggcactctaaggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgtaacacccgaagtcggtgaggtaaccttagggagccagccgccgaaggtgggacagatgattggggtgaagtcgtaacaaggtagccgtatcggaaggtgcggctggatcacctcctttctaa

SEQ ID NO: 3828 - DNA, 1570 bp, Exiguobacterium antarcticum
  ref <308>: DATABASE ACCESSION NUMBER: NCBI ACCESSION: NZ_JMKS01000003.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcaggaagctcacggaactcttcggagggaagtgaggggaatgagcggcggacgggtgagtaacacgtaaggaacctgccttaaggattgggataactccgagaaatcggagctaataccggatagttcttcagaccgcatggtctgatgatgaaaggcgcttcggcgtcaccttgagatggccttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaataggcgtgagaggtaatgctcatgctatgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtacagaagagaagagtggaattccatgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatccccttgaccgcttgagagatcaagttttcccttcggggacaagggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccagaaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3829 - DNA, 1565 bp, Exiguobacterium aurantiacum
  ref <308>: DATABASE ACCESSION NUMBER: NCBI ACCESSION: NZ_UGGP01000001.1
  ref <309>: DATABASE ENTRY DATE: 2019-04-01
  ref <313>: RELEVANT RESIDUES IN SEQ ID NO: (1)..(1565)
tctttggagagtttgatcctggctcaggacgaacgctggcggcgtgcctaatacatgcaagtcgagcgcaggaagtcacctgaacccttcgggggggacgttgacggaatgagcggcggacgggtgagtaacacgtaaagaacctgccctcaggtctgggataaccacgagaaatcggggctaataccggatgggtcatcgaaccgcatggttcgaggatgaaaggcgcttcggcgtcgcctggggatggctttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggccttcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggtacagagatgtactttccccttcgggggcaggggtgacaggtggtgcatggttgtcgtcagctcgtgtcgtgagatgttgggttaagtcccgcaacgagcgcaacccttgtccttagttgccaccattcagttgggcactctaaggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgtaacacccgaagtcggtgaggtaaccttagggagccagccgccgaaggtgggacagatgattggggtgaagtcgtaacaaggtagccgtatcggaaggtgcggctggatcacctcctttct

SEQ ID NO: 3830 - DNA, 1175 bp, Exiguobacterium chiriqhucha
  ref <308>: DATABASE ACCESSION NUMBER: NCBI ACCESSION: NZ_JMEH01000010.1
  ref <309>: DATABASE ENTRY DATE: 2019-04-01
  ref <313>: RELEVANT RESIDUES IN SEQ ID NO: (1)..(1175)
tttggagagtttgatcctggctcaggacgaacgctggcggcgtgcctaatacatgcaagtcgagcgcaggaaatcgacggaacccttcggggggaagtcgacggaatgagcggcggacgggtgagtaacacgtaaagaacctgccctcaggtctgggataaccacgagaaatcggggctaataccggatgggtcatcggaccgcatggtccgaggatgaaaggcgcttcggcgtcgcctggggatggctttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggccttcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggtacagagatgtaccttccccttcgggggcaggggtgacaggtggtgcatggttgtcgtcagctcgtgtcgtgagatgttgggttaagtcccgcaacgagcgcaacccttgtccttagttgccaccattcagttgggcactctaaggaga

SEQ ID NO: 3831 - DNA, 235 bp, Exiguobacterium enclense
  ref <308>: DATABASE ACCESSION NUMBER: NCBI ACCESSION: NZ_FMYN01000004.1
  ref <309>: DATABASE ENTRY DATE: 2019-04-01
  ref <313>: RELEVANT RESIDUES IN SEQ ID NO: (1)..(235)
ttcatggagagtttgatcctggctcaggacgaacgctggcggcgtgcctaatacatgcaagtcgagcgcaggaaactgacggaactcttcggagggaaggcagcggaatgagcggcggacgggtgagtaacacgtaaggaacctgcctcaaggattgggataactccgagaaatcggagctaataccggatagttcaacggaccgcatggtccgctgatgaaaggcgctccggcg

SEQ ID NO: 3832 - DNA, 1466 bp, Exiguobacterium indicum
  ref <308>: DATABASE ACCESSION NUMBER: NCBI ACCESSION: NZ_MPSZ01000021.1
  ref <309>: DATABASE ENTRY DATE: 2019-04-01
  ref <313>: RELEVANT RESIDUES IN SEQ ID NO: (1)..(1466)
ggaatgagcggcggacgggtgagtaacacgtaaggaacctgcctcaaggattgggataactccgagaaatcggagctaataccggatagttcatcggaccgcatggtccgttgatgaaaggcgctccggcgtcaccttgagatggccttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagagggaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcattcagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3833 - DNA, 1567 bp, Exiguobacterium marinum
  ref <308>: DATABASE ACCESSION NUMBER: NCBI ACCESSION: NZ_KK211189.1
  ref <309>: DATABASE ENTRY DATE: 2019-04-01
  ref <313>: RELEVANT RESIDUES IN SEQ ID NO: (1)..(1567)
tctttggagagtttgatcctggctcaggacgaacgctggcggcgtgcctaatacatgcaagtcgagcgcaggaagccgttccgaacccttcggggggacgacggtggaatgagcggcggacgggtgagtaacacgtaaagaacctgcccataggtctgggataaccacgagaaatcggggctaataccggatgtgtcatcggaccgcatggtccgctgatgaaaggcgcttcggcgtcgcccatggatggctttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggttttcggatcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggtacagagatgtaccttccccttcgggggcaggggtgacaggtggtgcatggttgtcgtcagctcgtgtcgtgagatgttgggttaagtcccgcaacgagcgcaacccttgtccttagttgccagcattcagttgggcactctaaggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagtcggtgaggtaaccgtaaggagccagccgccgaaggtggggcagatgattggggtgaagtcgtaacaaggtagccgtatcggaaggtgcggctggatcacctcctttctaa

SEQ ID NO: 3834 - DNA, 1567 bp, Exiguobacterium mexicanum
  ref <308>: DATABASE ACCESSION NUMBER: NCBI ACCESSION: NZ_JQGI01000018.1
  ref <309>: DATABASE ENTRY DATE: 2019-04-01
  ref <313>: RELEVANT RESIDUES IN SEQ ID NO: (1)..(1567)
ttctttggagagtttgatcctggctcaggacgaacgctggcggcgtgcctaatacatgcaagtcgagcgcaggaaatcgacggaacccttcggggggaagtcgacggaatgagcggcggacgggtgagtaacacgtaaagaacctgccctcaggtctgggataaccacgagaaatcggggctaataccggatgggtcatcggaccgcatggtccgaggatgaaaggcgcttcggcgtcgcctggggatggctttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggccttcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggtacagagatgtaccttccccttcgggggcaggggtgacaggtggtgcatggttgtcgtcagctcgtgtcgtgagatgttgggttaagtcccgcaacgagcgcaacccttgtccttagttgccagcatttagttgggcactctaaggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgtaacacccgaagtcggtgaggtaaccttagggagccagccgccgaaggtgggacagatgattggggtgaagtcgtaacaaggtagccgtatcggaaggtgcggctggatcacctcctttctaa

SEQ ID NO: 3835 - DNA, 1565 bp, Exiguobacterium oxidotolerans
  ref <308>: DATABASE ACCESSION NUMBER: NCBI ACCESSION: NZ_JNIS01000001.1
  ref <309>: DATABASE ENTRY DATE: 2019-04-01
  ref <313>: RELEVANT RESIDUES IN SEQ ID NO: (1)..(1565)
tttatggagagtttgatcctggctcaggacgaacgctggcggcgtgcctaatacatgcaagtcgagcgcaggaagctcgcggaactcttcggagggaagcgagtggaatgagcggcggatgggtgagtaacacgtaaggaacctgcctcaaggattgggataactccgagaaatcggagctaataccggatagttcttcggaccgcatggtccgaagatgaaaggcgcttcggcgtcaccttgagatggccttgcggtgcattagctagttggtggggtaatggcctaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacagatacgagaggtaatgctcgtatcctgacggtaccttgcgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtacagaagagaagagtggaattccatgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatccccttgaccgcttgagagatcaagttttcccttcggggacaagggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccagaaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttcta

SEQ ID NO: 3836 - DNA, 1619 bp, Exiguobacterium profundum
  misc_feature (1155)..(1155): n is a, c, g, or t
  ref <308>: DATABASE ACCESSION NUMBER: NCBI ACCESSION: NZ_MRSV01000001.1
  ref <309>: DATABASE ENTRY DATE: 2019-04-01
  ref <313>: RELEVANT RESIDUES IN SEQ ID NO: (1)..(1619)
ttggagagtttgatcctggctcaggacgaacgctggcggcgtgcctaatacatgcaagtcgagcgcaggaagccgtctgaacccttcggggggacgacggtggaatgagcggcggacgggtgagtaacacgtaaagaacctgcccataggtctgggataaccacgagaaatcggggctaataccggatgtgtcatcggaccgcatggtccgctgatgaaaggcgctccggcgtcgcccatggatggctttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggctttcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggtacagagatgtaccttccccttcgggggcaggggtgacaggtggtgcatggttgtcgtcagctcgtgtcgtgagatgttgggttaagtcccgcaacgagcgcaacccttgtccttagttgccagcattanatgttgggttaagtcccgcaacgagcgcaacccttgtccttagttgccagcatttagttgggcactctagggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagtcggtgaggtaaccgtaaggagccagccgccgaaggtggggcagatgattggggtgaagtcgtaacaaggtagccgtatcggaaggtgcggctggatcacctcctttctaa

SEQ ID NO: 3837 - DNA, 1570 bp, Exiguobacterium sibiricum
  ref <308>: DATABASE ACCESSION NUMBER: NCBI ACCESSION: NZ_KK211190.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcaggaagctcacggaactcttcggagggaagtgaggggaatgagcggcggacgggtgagtaacacgtaaggaacctgccccaaggattgggataactccgagaaatcggagctaataccgaatagttcttcagaccgcatggtctgatgatgaaaggcgctccggcgtcaccttgggatggccttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacaagtacgagaggtaatgctcgtaccttgacggtaccttgcgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtacagaagagaagagtggaattccatgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatccccttgaccgcttgagagatcaagtttccccttcggggacaagggtgacaggtggtgcatggttgtcgtcagctcgtgtcgtgagatgttgggttaagtcccgcaacgagcgcaacccctatccttagttgccagcattcagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccagaaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3838 - DNA, 1468 bp, Exiguobacterium sp. AB2
  ref <308>: DATABASE ACCESSION NUMBER: NCBI ACCESSION: NZ_JNAA01000091.1
  ref <309>: DATABASE ENTRY DATE: 2019-04-01
  ref <313>: RELEVANT RESIDUES IN SEQ ID NO: (1)..(1468)
gttgacggaatgagcggcggacgggtgagtaacacgtaaagaacctgccctcaggtctgggataaccacgagaaatcggggctaataccggatgggtcatcggaccgcatggtccgaggatgaaaggcgctccggcgtcgcctggggatggctttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggccctcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggcacagagatgtgccttccccttcgggggcaggggtgacaggtggtgcatggttgtcgtcagctcgtgtcgtgagatgttgggttaagtcccgcaacgagcgcaacccttgtccttagttgccaccattcagttgggcactctaaggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgtaacacccgaagtcggtgaggtaaccttagggagccagccgccgaaggtgggacagatgattggggtgaagtcgtaacaaggtagccgtatcggaaggtgcggctggatcacctcctttctaa

SEQ ID NO: 3839 - DNA, 948 bp, Exiguobacterium sp. AM39-5BH
  ref <308>: DATABASE ACCESSION NUMBER: NCBI ACCESSION: NZ_QSGS01000044.1
  ref <309>: DATABASE ENTRY DATE: 2019-04-01
  ref <313>: RELEVANT RESIDUES IN SEQ ID NO: (1)..(948)
cggaacccttcggggggaagtcgacggaatgagcggcggacgggtgagtaacacgtaaagaacctgccctcaggtctgggataaccacgagaaatcggggctaataccggatgggtcatcggaccgcatggtccgaggatgaaaggcgctccggcgccgcctggggatggctttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggccctcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccgg

SEQ ID NO: 3840 - DNA, 954 bp, Exiguobacterium sp. AT1b
  ref <308>: DATABASE ACCESSION NUMBER: NCBI ACCESSION: NZ_MOEL01000006.1
  ref <309>: DATABASE ENTRY DATE: 2019-04-01
  ref <313>: RELEVANT RESIDUES IN SEQ ID NO: (1)..(954)
ctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggtacagagatgtaccttccccttcgggggcaggggtgacaggtggtgcatggttgtcgtcagctcgtgtcgtgagatgttgggttaagtcccgcaacgagcgcaacccttgtccttagttgccagcatttggttgggcactctagggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagtcggtgaggtaaccgtaaggagccagccgccgaaggtggggcagatgattggggtgaagtcgtaacaaggtagccgtatcggaaggtgcggctggatcacctcctttctaaggaa

SEQ ID NO: 3841 - DNA, 1570 bp, Exiguobacterium sp. BMC-KP
  ref <308>: DATABASE ACCESSION NUMBER: NCBI ACCESSION: NZ_LGIW01000006.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcaggaagctgacggaactcttcggagggaaggcagtggaatgagcggcggacgggtgagtaacacgtaaggaacctgcctcaaggattgggataactccgagaaatcggagctaataccggatagttcaacggaccgcatggtccgctgatgaaaggcgctccggcgtcaccttgagatggccttgcggtgcattagctagttggtgaggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagagggaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3842 - DNA, 1570 bp, Exiguobacterium sp. HF60
  ref <308>: DATABASE ACCESSION NUMBER: NCBI ACCESSION: NZ_QPKS01000015.1
  ref <309>: DATABASE ENTRY DATE: 2019-04-01
  ref <313>: RELEVANT RESIDUES IN SEQ ID NO: (1)..(1570)
ttcatggagagtttgatcctggctcaggacgaacgctggcggcgtgcctaatacatgcaagtcgagcgcaggaagcgcgcggaacccttcggggggaagcgcacggaatgagcggcggacgggtgagtaacacgtaaggaacctgccccagggactgggataactccgagaaatcggagctaataccggatctgtcacgagaccgcatggtcccgtgatgaaaggcgctccggcgtcaccttgggatggccttgcggtgcattagctagttggcggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacaagcgtgagagggaatgctcacgccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccgctgaccgcttgagagatcaagtttccccttcgggggcagcggtgacaggtggtgcatggttgtcgtcagctcgtgtcgtgagatgttgggttaagtcccgcaacgagcgcaacccctgtccttagttgccagcattcagttgggcactctagggagactgccggtgacaaaccggaggaaggtggggatgacgtcaaatcatcatgccccttatgagttgggctacacacgtgctacaatggacggtacaaagggccgcgaaaccgcgaggtggagccaatcccagaaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3843 - DNA, 1567 bp, Exiguobacterium sp. HVEsp1
  ref <308>: DATABASE ACCESSION NUMBER: NCBI ACCESSION: NZ_KV917367.1
  ref <309>: DATABASE ENTRY DATE: 2019-04-01
  ref <313>: RELEVANT RESIDUES IN SEQ ID NO: (1)..(1567)
ttctttggagagtttgatcctggctcaggacgaacgctggcggcgtgcctaatacatgcaagtcgagcgcaggaagccgtctgaacccttcggggggacgacggtggaatgagcggcggacgggtgagtaacacgtaaagaacctgcccataggtctgggataaccacgagaaatcggggctaataccggatgtgtcatcggaccgcatggtccgctgatgaaaggcgctccggcgtcgcccatggatggctttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggctttcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggtacagagatgtaccttccccttcgggggcaggggtgacaggtggtgcatggttgtcgtcagctcgtgtcgtgagatgttgggttaagtcccgcaacgagcgcaacccttgtccttagttgccagcatttggttgggcactctagggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagtcggtgaggtaaccgtaaggagccagccgccgaaggtggggcagatgattggggtgaagtcgtaacaaggtagccgtatcggaaggtgcggctggatcacctcctttctaa

SEQ ID NO: 3844 - DNA, 1567 bp, Exiguobacterium sp. JLM-2
  ref <308>: DATABASE ACCESSION NUMBER: NCBI ACCESSION: NZ_LDNY01000009.1
  ref <309>: DATABASE ENTRY DATE: 2019-04-01
  ref <313>: RELEVANT RESIDUES IN SEQ ID NO: (1)..(1567)
ttctttggagagtttgatcctggctcaggacgaacgctggcggcgtgcctaatacatgcaagtcgagcgcaggaagccgtctgaacccttcggggggacgacggtggaatgagcggcggacgggtgagtaacacgtaaagaacctgcccataggtctgggataaccacgagaaatcggggctaataccggatgtgtcatcggaccgcatggtccgctgatgaaaggcgctccggcgtcgcccatggatggctttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggctttcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggtacagagatgtaccttccccttcgggggcaggggtgacaggtggtgcatggttgtcgtcagctcgtgtcgtgagatgttgggttaagtcccgcaacgagcgcaacccttgtccttagttgccagcattaagttgggcactctagggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagtcggtgaggtaaccgtaaggagccagccgccgaaggtggggcagatgattggggtgaagtcgtaacaaggtagccgtatcggaaggtgcggctggatcacctcctttctaa

SEQ ID NO: 3845 - DNA, 1570 bp, Exiguobacterium sp. KKBO11
  ref <308>: DATABASE ACCESSION NUMBER: NCBI ACCESSION: NZ_LUCU01000003.1
  ref <309>: DATABASE ENTRY DATE: 2019-04-01
  ref <313>: RELEVANT RESIDUES IN SEQ ID NO: (1)..(1570)
ttcatggagagtttgatcctggctcaggacgaacgctggcggcgtgcctaatacatgcaagtcgagcgcaggaaactgacggaactcttcggagggaaggcagtggaatgagcggcggacgggtgagtaacacgtaaggaacctgcctcaaggattgggataactccgagaaatcggagctaataccggatagttcaacggaccgcatggtccgctgatgaaaggcgcttcggcgtcaccttgagatggccttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagaggtaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcattgagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3846 - DNA, 1467 bp, Exiguobacterium sp. KRL4
  ref <308>: DATABASE ACCESSION NUMBER: NCBI ACCESSION: NZ_MOLV01000030.1
  ref <309>: DATABASE ENTRY DATE: 2019-04-01
  ref <313>: RELEVANT RESIDUES IN SEQ ID NO: (1)..(1467)
gggaatgagcggcggacgggtgagtaacacgtaaggaacctgccttaaggattgggataactccgagaaatcggagctaataccggatagttcttcagaccgcatggtctgatgatgaaaggcgcttcggcgtcaccttgagatggccttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacaggtgtgagaggtaatgctcatgctatgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtacagaagagaagagtggaattccatgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatccccttgaccgcttgagagatcaagttttcccttcggggacaagggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccagaaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3847 - DNA, 1050 bp, Exiguobacterium sp. Leaf187
  ref <308>: DATABASE ACCESSION NUMBER: NCBI ACCESSION: NZ_LMPR01000001.1
  ref <309>: DATABASE ENTRY DATE: 2019-04-01
  ref <313>: RELEVANT RESIDUES IN SEQ ID NO: (1)..(1050)
acggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcattcagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgtaaggagccagccgtcgaaggtggggtagatgattggggtgaagtcgtaacaaggtagccgtatcggaaggtgcggctggatcacctcctttctaaggaa

SEQ ID NO: 3848 - DNA, 1321 bp, Exiguobacterium sp. Leaf196
  ref <308>: DATABASE ACCESSION NUMBER: NCBI ACCESSION: NZ_LMPV01000001.1
  ref <309>: DATABASE ENTRY DATE: 2019-04-01
  ref <313>: RELEVANT RESIDUES IN SEQ ID NO: (1)..(1321)
ccttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagaggwaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcattcagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3849 - DNA, 1570 bp, Exiguobacterium sp. MH3
  ref <308>: DATABASE ACCESSION NUMBER: NCBI ACCESSION: NC_022794.1
  ref <309>: DATABASE ENTRY DATE: 2019-04-01
  ref <313>: RELEVANT RESIDUES IN SEQ ID NO: (1)..(1570)
ttcatggagagtttgatcctggctcaggacgaacgctggcggcgtgcctaatacatgcaagtcgagcgcaggaaactgacggaactcttcggagggaaggcagtggaatgagcggcggacgggtgagtaacacgtaaggaacctgcctcaaggattgggataactccgagaaatcggagctaataccggatagttcatcggaccgcatggtccgttgatgaaaggcgctccggcgtcaccttgagatggccttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagaggaaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3850 - DNA, 1572 bp, Exiguobacterium sp. N4-1P
  ref <308>: DATABASE ACCESSION NUMBER: NCBI ACCESSION: NZ_CP022236.1
  ref <309>: DATABASE ENTRY DATE: 2019-04-01
  ref <313>: RELEVANT RESIDUES IN SEQ ID NO: (1)..(1572)
tttatggagagtttgatcctggctcaggacgaacgctggcggcgtgcctaatacatgcaagtcgagcgcaggaagctcgcggaactcttcggagggaagcaagtggaaagtggaatgagcggcggacgggtgagtaacacgtaaggaacctgcctcaaggattgggataactccgagaaatcggagctaataccggatagttcttcggaccgcatggtccgatgatgaaaggcgctccggcgtcaccttgagatggccttgcggtgcattagctagttggtggggtaatggcctaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacagatacgagaggtaatgctcgtatcctgacggtaccttgcgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtacagaagagaagagtggaattccatgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatccccttgaccgcttgagagatcaagttttcccttcggggacaagggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccagaaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttcta

SEQ ID NO: 3851 - DNA, 1568 bp, Exiguobacterium sp. NG55
  ref <308>: DATABASE ACCESSION NUMBER: NCBI ACCESSION: NZ_JPOD01000001.1
  ref <309>: DATABASE ENTRY DATE: 2019-04-01
  ref <313>: RELEVANT RESIDUES IN SEQ ID NO: (1)..(1568)
ttctttggagagtttgatcctggctcaggacgaacgctggcggcgtgcctaatacatgcaagtcgagcgcaggaagccgtctgaacccttcgggggggacgacggtggaatgagcggcggacgggtgagtaacacgtaaagaacctgcccataggtctgggataaccacgagaaatcggggctaataccggatgtgtcatcggaccgcatggtccgctgatgaaaggcgctccggcgtcgcccatggatggctttgcggtgcattagctagttggtggggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggctttcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggtacagagatgtaccttccccttcgggggcaggggtgacaggtggtgcatggttgtcgtcagctcgtgtcgtgagatgttgggttaagtcccgcaacgagcgcaacccttgtccttagttgccagcatttggttgggcactctagggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagtcggtgaggtaaccgtaaggagccagccgccgaaggtggggcagatgattggggtgaagtcgtaacaaggtagccgtatcggaaggtgcggctggatcacctcctttctaa

SEQ ID NO: 3852 - DNA, 1340 bp, Exiguobacterium sp. RIT341
  ref <308>: DATABASE ACCESSION NUMBER: NCBI ACCESSION: NZ_JFYW01000015.1
  ref <309>: DATABASE ENTRY DATE: 2019-04-01
  ref <313>: RELEVANT RESIDUES IN SEQ ID NO: (1)..(1340)
cggcgtcaccttgagatggccttgcggtgcattagctagttggtggggtaacggctcaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagagggaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcattcagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3853 - DNA, 1570 bp, Exiguobacterium sp. RIT452
  ref <308>: DATABASE ACCESSION NUMBER: NCBI ACCESSION: NZ_QXJB01000019.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcaggaagctcacggaactcttcggagggaagtgaagggaatgagcggcggacgggtgagtaacacgtaaggaacctgccccaaggattgggataactccgagaaatcggagctaataccgaatagttcttcagaccgcatggtctgatgatgaaaggcgcttcggcgtcaccttgggatggccttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacaggtatgagaggtaatgctcatgctatgacggtaccttgcgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtacagaagagaagagtggaattccatgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatccccttgaccgcttgagagatcaagtttccccttcgggggcaagggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccagaaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3854 - DNA, 1570 bp, Exiguobacterium sp. RIT594
  ref <308>: DATABASE ACCESSION NUMBER: NCBI ACCESSION: NZ_QPKF01000016.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcaggaagctcacggaactcttcggagggaagtgaagggaatgagcggcggacgggtgagtaacacgtaaggaacctgccccaaggattgggataactccgagaaatcggagctaataccgaatagttcttcagaccgcatggtctgatgatgaaaggcgctccggcgtcaccttgggatggccttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacaagtacgagaggtaatgctcgtaccttgacggtaccttgcgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtacagaagagaagagtggaattccatgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatccccttgaccgcttgagagatcaagtttccccttcgggggcaagggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccagaaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3855 - DNA, 1568 bp, Exiguobacterium sp. SH31
  ref <308>: DATABASE ACCESSION NUMBER: NCBI ACCESSION: NZ_LYTG01000053.1
  ref <309>: DATABASE ENTRY DATE: 2019-04-01
  ref <313>: RELEVANT RESIDUES IN SEQ ID NO: (1)..(1568)
ttctttggagagtttgatcctggctcaggacgaacgctggcggcgtgcctaatacatgcaagtcgagcgcaggaaatcggcggaacccttcggggggaagtcgacggaatgagcggcggacgggtgagtaacacgtaaagaacctgccctcaggtctgggataaccacgagaaatcggggctaataccggatgggtcatcgaaccgcatggttcgaggatgaaaggcgcttcggcgtcgcctggggatggctttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggccttcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaaactcaaaggaattgacggggacccgcacaagcggtggagcatgtggtttaattcgacgcaacgcgaagaaccttaccaactcttgacatccccctgaccggtacagagatgtaccttccccttcgggggcaggggtgacaggtggtgcatggttgtcgtcagctcgtgtcgtgagatgttgggttaagtcccgcaacgagcgcaacccttgtccttagttgccaccattcagttgggcactctaaggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgtaacacccgaagtcggtgaggtaaccgcaaggagccagccgccgaaggtgggacagatgattggggtgaagtcgtaacaaggtagccgtatcggaaggtgcggctggatcacctcctttctaa

SEQ ID NO: 3856 - DNA, 1420 bp, Exiguobacterium sp. TNDT2
  ref <308>: DATABASE ACCESSION NUMBER: NCBI ACCESSION: NZ_QLVE01000040.1
  ref <309>: DATABASE ENTRY DATE: 2019-04-01
  ref <313>: RELEVANT RESIDUES IN SEQ ID NO: (1)..(1420)
tcgacggaacccttcggggggaagtcgacggaatgagcggcggacgggtgagtaacacgtaaagaacctgccctcaggtctgggataaccacgagaaatcggggctaataccggatgggtcatcggaccgcatggtccgaggatgaaaggcgctccggcgtcgcctggggatggctttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgaacgatgaaggccctcgggtcgtaaagttctgttgtaagggaagaacaagtgccgcaggcaatggcggcaccttgacggtaccttgcgagaaagccacggctaactacgtgccagcagccgcggtaatacgtaggtggcaagcgttgtccggaattattgggcgtaaagcgcgcgcaggcggcctcttaagtctgatgtgaaagcccccggctcaaccggggagggccattggaaactgggaggcttgagtataggagagaagagtggaattccacgtgtagcggtgaaatgcgtagagatgtggaggaacaccagtggcgaaggcgactctttggcctataactgacgctgaggcgcgaaagcgtggggagcaaacaggattagataccctggtagtccacgccgtaaacgatgagtgctaggtgttggagggtttccgcccttcagtgctgaagctaacgcattaagcactccgcctggggagtacggtcgcaaggctgaaactcaaaggaattgacggggacccgcacaagcggtggagcatgtggtttaattcgaagcaacgcgaagaaccttaccaactcttgacatccccctgaccggtacagagatgtgccttccccttcgggggcaggggtgacaggtggtgcatggttgtcgtcagctcgtgtcgtgagatgttgggttaagtcccgcaacgagcgcaacccttgtccttagttgccagcatttggttgggcactctaaggagactgccggtgacaaaccggaggaaggtggggatgacgtcaaatcatcatgccccttatgagttgggctacacacgtgctacaatggacggtacaaagggcagcgaagccgcgaggtggagccaatcccagaaagccgttctcagttcggattgcaggctgcaactcgcctgcatgaagtcggaatcgctagtaatcgcaggtcagcatactgcggtgaatacgttcccgggtcttgtacacaccgcccgtcacaccacgagagtttgtaacacccgaagtcggtgaggtaaccttagggagccagccgccgaaggtggg

SEQ ID NO: 3857 - DNA, 1570 bp, Exiguobacterium sp. U13-1
  ref <308>: DATABASE ACCESSION NUMBER: NCBI ACCESSION: NZ_CP015731.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcaggaaactgacggaactcttcggagggaaggcagtggaatgagcggcggacgggtgagtaacacgtaaggaacctgcctcaaggattgggataactccgagaaatcggagctaataccggatagttcaacggaccgcatggtccgctgatgaaaggcgctccggcgtcaccttgagatggccttgcggtgcattagctagttggtgaggtaacggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagaggtaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3858 - DNA, 1570 bp, Exiguobacterium sp. ZWU0009
  ref <308>: DATABASE ACCESSION NUMBER: NCBI ACCESSION: NZ_CP018057.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcaggaaactgacggaactcttcggagggaaggcagtggaatgagcggcggacgggtgagtaacacgtaaggaacctgcctcaaggattgggataactccgagaaatcggagctaataccggatagttcaacggaccgcatggtccgctgatgaaaggcgcttcggcgtcaccttgagatggccttgcggtgcattagctagttggtggggtaacggctcaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacacgtacgagaggtaatgctcgtaccttgacggtaccttacgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatcccattgaccgcttgagagatcaagttttcccttcggggacaatggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccataaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3859 - DNA, 1570 bp, Exiguobacterium undae
  ref <308>: DATABASE ACCESSION NUMBER: NCBI ACCESSION: NZ_LVVL01000013.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcaggaagctcacggaactcttcggagggaagtgaagggaatgagcggcggacgggtgagtaacacgtaaggaacctgccccaaggattgggataactccgagaaatcggagctaataccgaatagttcttcagaccgcatggtctgatgatgaaaggcgcttcggcgtcaccttgggatggccttgcggtgcattagctagttggtggggtaatggcccaccaaggcgacgatgcatagccgacctgagagggtgatcggccacactgggactgagacacggcccagactcctacgggaggcagcagtagggaatcttccacaatggacgaaagtctgatggagcaacgccgcgtgagtgatgaaggttttcggatcgtaaaactctgttgtaagggaagaacaggtatgagaggtaatgctcatgctatgacggtaccttgcgagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtacagaagagaagagtggaattccatgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaggtgttggggggtttccgcccctcagtgctgaagctaacgcattaagcactccgcctggggagtacggccgcaaggctgaaactcaaaggaattgacggggacccgcacaagcggtggagcatgtggtttaattcgaagcaacgcgaagaaccttaccaactcttgacatccccttgaccgcttgagagatcaagttttcccttcggggacaagggtgacaggtggtgcatggttgtcgtcagctcgtgtcgtgagatgttgggttaagtcccgcaacgagcgcaacccctatccttagttgccagcatttagttgggcactctagggagactgccggtgacaaaccggaggaaggtggggatgacgtcaaatcatcatgccccttatgagttgggctacacacgtgctacaatggacggtacaaagggcagcgagaccgcgaggtggagccaatcccagaaagccgttcccagttcggattgcaggctgcaactcgcctgcatgaagtcggaatcgctagtaatcgcaggtcagcatactgcggtgaatacgttcccgggtcttgtacacaccgcccgtcacaccacgagagtttgcaacacccgaagccggtgaggtaaccgcaaggagccagccgtcgaaggtggggtagatgattggggtgaagtcgtaacaaggtagccgtatcggaaggtgcggctggatcacctcctttctaaggaa

SEQ ID NO: 3860 - DNA, 1541 bp, Extensimonas vulgaris
  ref <308>: DATABASE ACCESSION NUMBER: NCBI ACCESSION: NZ_QPJU01000022.1
  ref <309>: DATABASE ENTRY DATE: 2019-04-01
  ref <313>: RELEVANT RESIDUES IN SEQ ID NO: (1)..(1541)
agatcaaacaaaagagtttgatcctggctcagattgaacgctggcggcatgccttacacatgcaagtcgaacggcagcacggacttcggtctggtggcgagtggcgaacgggtgagtaaagcatcggaacgtgcccgatcgtgggggataactactcgaaagagtagctaataccgcataagatctacggatgaaagcgggggactcgcaagagcctcgcgcgagcggagcggccgatgtcagattaggtagttggtggggtaaaggcccaccaagccgacgatctgtagctggtctgagaggacgaccagccacactgggactgagacacggcccagactcctacgggaggcagcagtggggaattttggacaatgggcgcaagcctgatccagccatgccgcgtgcaggaagaaggccctcgggttgtaaactgcttttgtacggagcgaaaaagctgccactaacactgggagcccatgacggtaccgtaagaataagcaccggctaactacgtgccagcagccgcggtaatacgtagggtgcaagcgttaatcggaattactgggcgtaaagcgtgcgcaggcggttttgtaagacagaggtgaaatccccgggctcaacctgggaactgcctttgtgactgcaaggctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttagctgactcagtaacgaagccaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatggcaggaatcctgaagagatttgggagtgctcgaaagagaacctgcacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggccggtacagagggtagccaacccgcgagggggagccaatcccacaaagccggtcgtagtccggatcgcagtctgcaactcgactgcgtgaagtcggaatcgctagtaatcgcggatcagcatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 3861 - DNA, 1547 bp, Ezakiella peruensis
  ref <308>: DATABASE ACCESSION NUMBER: NCBI ACCESSION: NZ_LT962470.1
  ref <309>: DATABASE ENTRY DATE: 2019-04-01
  ref <313>: RELEVANT RESIDUES IN SEQ ID NO: (1)..(1547)
tttacttgagagtttgatcctggctcaggacgaacgctggcggcgtgcttaacacatgcaagtcgaacgatgaagaagagaaacgcgaacttcggttcaaatttcacttcggattagtggcagacgggtgagtaacgcgtgagcaacctacctcttacaaagggatagcctcgggaaaccgtgattaataccatatgacacattcataaggcatcttaagaatgttaaagctacggcggtaagagatgggctcgcgtcccattagctagttggtgaggtaacggcccaccaaggcaacgatgggtaaccggcctgagagggtgaacggtcacattggaactgagacacggtccaaactcctacgggaggcagcagtggggaatattgcacaatggagggaactctgatgcagcgacgccgcgtgagcgatgaaggaattcgtttcgtaaagctctgttctatgggaagaaaaggactgtaccataggagaaagccccggctaaatacgtgccagcagccgcggtaatacgtatggggcgagcgttgtccggaattattgggcgtaaagggtacgcaggcggtttaccaagttggatgtgaaatcttgtagctcaactacaaacgtgcatccaaaactggctaacttgagttaaggagaggtaagtggaattcctggtgtagcggtggaatgcgtagatatcaggaggaataccggtggcgaaggcgacttactggacttatactgacgctgaggtacgaaagcgtggggagcaaacaggattagataccctggtagtccacgccgtaaacgatgagtgctaggtgtcgggggtcaaacctcggtgccgacgttaacacattaagcactccgcctggggagtacgtgcgcaagcatgaaactcaaaggaattgacggggacccgcacaagcagcggagcatgtggtttaattcgtggctacgcgaagaaccttaccagggcttgacatatatatgaggggacatagagatatgaaaccagtaagagcttgctcttaacatatatacaggtggtgcatggttgtcgtcagctcgtgtcgtgagatgttgggttaagtcccgcaacgagcgcaacccttgcatatagttactaacagatcatgctgaggactctatatggactgccgatgataaatcggaggaaggtggggatgacgtcaaatcatcatgccctttatgtcctgggctacacacgtgctacaatggtcggtacaaagagcagcgaaatggtgacatcaagcgaatctcaaaaagccgatcccagttcggattgtactctgcaactcgagtacatgaagtcggagttgctagtaatcgtagatcagaatgctacggtgaatgcgttcccgggtcttgtacacaccgcccgtcacaccatggaagttggcaatacccgaagccgatggcctaacctttaagggaggagtcgtcgaaggtagggtcaatgactggggtgaagtcgtaacaaggtagccgtatcggaaggtgcggctggatcacctcctttcta

SEQ ID NO: 3862 - DNA, 1557 bp, Facklamia hominis
  ref <308>: DATABASE ACCESSION NUMBER: NCBI ACCESSION: NZ_RYDT01000036.1
  ref <309>: DATABASE ENTRY DATE: 2019-04-01
  ref <313>: RELEVANT RESIDUES IN SEQ ID NO: (1)..(1557)
tttcatgagagtttgatcctggctcaggacgaacgctggcggcgtgcctaatacatgcaagtcgaacgaacggagctaggaacttgttcccggcaaagttagtggcgcacgggtgagtaacacgtggagaacctacccttttgcgggggataaccattggaaacgatgactaataccgcatagaatcgcagatcgcatgatcaacgaaggaaagacggcttcggctgtcgcaaaaggatggctccgcggtgcattagctagatggtggggtaacggcctaccatggcaatgatgcatagccgacctgagagggtgatcggccacattgggactgagacacggcccaaactcctacgggaggcagcagtagggaatcttccgcaatgggcgcaagcctgacggagcaacgccgcgtgtgtgaagaaggtcttcggatcgtaaagcactgttgttagagaagaacgaccgctagagtaactgttagcggagtgacggtatctaaccagaaagccacggctaactacgtgccagcagccgcggtaatacgtaggtggcaagcgttgtccggatttattgggcgtaaagggagcgcaggcggtgacttaagtctgatgtgaaagcccacggctcaaccgtggagggtcattggaaactgggtcacttgagtgcagaagaggaaagtggaattccatgtgtagcggtgaaatgcgtagatatatggaggaacaccagtggcgaaggcgactttctggtctgtaactgacgctgaggctcgaaagcgtggggagcaaacaggattagataccctggtagtccacgccgtaaacgatgagtgctaagtgttggagggtttccacccttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatctcttgcatagcctagagataggtgaagcccttcggggcaagaagacaggtggtgcatggttgtcgtcagctcgtgtcgtgagatgttgggttaagtcccgcaacgagcgcaacccttatcactagttgccagcattcagatggggactctagtgagactgccggtgacaaaccggaggaaggtggggatgacgtcaaatcatcatgccccttatgacctgggctacacacgtgctacaatggatggtacaacgagcagcgaactcgcaagggcaagcgaatctcttaaagccattctcagttcggattgttctctgcaactcgagaacatgaagccggaatcgctagtaatcgcggatcagcacgccgcggtgaatacgttcccgggtcttgtacacaccgcccgtcacaccacgagagtttgtaacacccgaagccggtggcctaactttatgagggagccgtcgaaggtgggacagatgattggggtgaagtcgtaacaaggtagccgtatcggaaggtgcggctggatcacctcctttctaagga

SEQ ID NO: 3863 - DNA, 1559 bp, Facklamia ignava
  ref <308>: DATABASE ACCESSION NUMBER: NCBI ACCESSION: NZ_PKHE01000036.1
  ref <309>: DATABASE ENTRY DATE: 2019-04-01
  ref <313>: RELEVANT RESIDUES IN SEQ ID NO: (1)..(1559)
tttcatgagagtttgatcctggctcaggatgaacgctggcggcgtgcctaatacatgcaagtcgaacgcgccgagaagggaacttgttcctttcaacgcgagtggcgaacgggtgagtaacacgtgggaaacctacccttcagcgggggataaccatcggaaacgatgactaataccgcatagttgttctagtcgcatgactggaatgggaaagacggcttcggctgtcactgaaggatggtcccgcggtgcattagctagacggtggggtaacggcctaccgtggctttgatgcatagccgacctgagagggtgatcggccacattgggactgagacacggcccaaactcctacgggaggcagcagtagggaatcttccgcaatggacgcaagtctgacggagcaacgccgcgtgtgtgaagaaggtcttcggatcgtaaagcactgttatcagagaagaatagcctgtagagtaactgttataggtttgacggtaactgatcagaaagccacggctaactacgtgccagcagccgcggtaatacgtaggtggcaagcgttatccggatttattgggcgtaaagggagcgcaggcggttgattaagtctgatgtgaaagcccacggctcaaccgtggagttgcattggaaactggtcaacttgagtacagaagaggaaagcggaattccatgtgtagcggtgaaatgcgtagatatatggaggaacaccagtggcgaaggcggctttctggtctgaaactgacgctgaggctcgaaagcgtggggagcaaacaggattagataccctggtagtccacgccgtaaacgatgagtgttaagtgttggggggtttccgcccctcagtgctggcgcaaacgcaataaacactccgcctggggagtacggccgcaaggctgaaactcaaaggaattgacggggacccgcacaagcggtggagcatgtggtttaattcgaagcaacgcgaagaaccttaccaggtcttgacatctcttgcatagcctagagataggtgaaatcctacgggacaagaagacaggtggtgcatggttgtcgtcagctcgtgtcgtgagatgttgggttaagtcccgcaacgagcgcaacccttataactagttgccagcattgagttggggactctagttagactgccggtgacaaaccggaggaaggtggggatgacgtcaaatcatcatgccccttatgacctgggctacacacgtgctacaatggatggtacagcgagaagcgacgtcgcgaggccaagcagatctcttaaagccattctcagttcggattgttctctgcaactcgagagcatgaagccggaatcgctagtaatcgtggatcagcacgccacggtgaatacgttcccgggtcttgtacacaccgcccgtcacaccacgagagtttgtaacacccgaagccggtggcctaaccattatggagggagccgtcgaaggtgggatggatgattggggtgaagtcgtaacaaggtagccgtatcggaaggtgcggctggatcacctcctttctaagga

SEQ ID NO: 3864 - DNA, 1556 bp, Facklamia languida
  ref <308>: DATABASE ACCESSION NUMBER: NCBI ACCESSION: NZ_JH601133.1
  ref <309>: DATABASE ENTRY DATE: 2019-04-01
  ref <313>: RELEVANT RESIDUES IN SEQ ID NO: (1)..(1556)
tttcatgagagtttgatcctggctcaggacgaacgctggcggcgtgcctaatacatgcaagtcgaacgaacagcgacttgaacttgttcaagtcaatgttagtggcgcacgggtgagtaacacgtggagaacctacccttaagcgggggataaccattggaaacgatgactaataccgcatagaatcacagatcgcatgatcaatgaaggaaagacggcttcggctgtcacttaaggatggctccgcggtgcattagctagatggtggggtaaaggcctaccatggcgatgatgcatagccgacctgagagggtgatcggccacattgggactgagacacggcccaaactcctacgggaggcagcagtagggaatcttccgcaatggacgcaagtctgacggagcaacgccgcgtgtgtgaagaaggtcttcggatcgtaaagcactgttgttagagaagaacgaccggtagagtaactgttaccggagtgacggtatctaaccagaaagccacggctaactacgtgccagcagccgcggtaatacgtaggtggcaagcgttgtccggatttattgggcgtaaagggagcgcaggcggtgacttaagtctgatgtgaaagcccacggctcaaccgtggagggtcattggaaactgggtcacttgagtacagaagaggaaagcggaattccatgtgtagcggtgaaatgcgtagatatatggaggaacaccagtggcgaaagcggctttctggtctgaaactgacgctgaggctcgaaagcgtggggagcaaacaggattagataccctggtagtccgcgccgtaaacgatgagtgctaagtgttggagggtttccacccttcagtgctggagttaacgcaataagcactccgcctggggagtacggtcgcaagactgaaactcaaaggaattgacggggacccgcacaagcggtggagcatgtggtttaattcgaagcaacgcgaagaaccttaccaggtcttgacataggatgcataacctagagataggtgaagtccttcgggacatccatacaggtggtgcatggttgtcgtcagctcgtgtcgtgagatgttgggttaagtcccgcaacgagcgcaacccttatcactagttgccagcattaagttggggactctagtgagactgccggtgacaaaccggaggaaggtggggatgacgtcaaatcatcatgccccttatgacctgggctacacacgtgctacaatggatggtacaacgagcagcgaactcgcaagggcaagcgaatctcttaaagccattctcagttcggattgttctctgcaactcgagaacatgaagccggaatcgctagtaatcgcggatcagcacgccgcggtgaatacgttcccgggtcttgtacacaccgcccgtcacaccacgagagtttgtaacacccgaagccggtggcctaacttaggagggagccgtcgaaggtgggatagatgattggggtgaagtcgtaacaaggtagccgtatcggaaggtgcggctggatcacctcctttctaagga

SEQ ID NO: 3865 - DNA, 1555 bp, Facklamia miroungae
  ref <308>: DATABASE ACCESSION NUMBER: NCBI ACCESSION: NZ_FNCK01000022.1
  ref <309>: DATABASE ENTRY DATE: 2019-04-01
  ref <313>: RELEVANT RESIDUES IN SEQ ID NO: (1)..(1555)
tttcatgagagtttgatcctggctcaggacgaacgctggcggcgtgcctaatacatgcaagtcgaacgaaccgcgagagaacttgttctttcaaggttagtggcgcacgggtgagtaacacgtggagaacctacccttcagcgggggataaccattggaaacgatgactaataccgcatagaatcgcagatcgcatgatcaacgaaggaaagacggcttcggctgtcactgaaggatggctccgcggtgcattagctagatggtggggtaaaagcctaccatggccatgatgcatagccgacctgagagggtgatcggccacattgggactgagacacggcccaaactcctacgggaggcagcagtagggaatcttccgcaatggacgcaagtctgacggagcaacgccgcgtgtgtgaagaaggtcttcggatcgtaaagcactgttgttagagaagaacgaccggatgagtaactgcattcggagtgacggtatctaaccagaaagccacggctaactacgtgccagcagccgcggtaatacgtaggtggcaagcgttgtccggatttattgggcgtaaagggagcgcaggcggtgacttaagtctgatgtgaaagcccacggctcaaccgtggagggtcattggaaactgggtcacttgagtatagaagaggaaagtggaattccatgtgtagcggtgaaatgcgtagatatatggaggaacaccagtggcgaaggcgactttctggtctataactgacgctgaggctcgaaagcgtggggagcaaacaggattagataccctggtagtccacgccgtaaacgatgagtgctaagtgttggagggtttccacccttcagtgctggagttaacgcaataagcactccgcctggggagtacggtcgcaagactgaaactcaaaggaattgacggggacccgcacaagcggtggagcatgtggtttaattcgaagcaacgcgaagaaccttaccaggtcttgacatctgctgcataacctagagataggtgaaatccttcgggacagcaagacaggtggtgcatggttgtcgtcagctcgtgtcgtgagatgttgggttaagtcccgcaacgagcgcaacccctatcattagttgccagcattcagttggggactctaatgagactgccggtgacaaaccggaggaaggtggggatgacgtcaaatcatcatgccccttatgacctgggctacacacgtgctacaatggatggtacaacgagcagcgaactcgcgagggtaagcgaatctctgaaagccattctcagttcggattgttctctgcaactcgagagcatgaagccggaatcgctagtaatcgcggatcagcacgccgcggtgaatacgttcccgggtcttgtacacaccgcccgtcacaccacgagagtttgtaacacccgaagccggtggcctaacttatagagggagccgtcgaaggtgggatagatgattggggtgaagtcgtaacaaggtagccgtatcggaaggtgcggctggatcacctcctttctaagga

SEQ ID NO: 3866 - DNA, 453 bp, Facklamia sourekii
  ref <308>: DATABASE ACCESSION NUMBER: NCBI ACCESSION: NZ_JADD01000030.1
  ref <309>: DATABASE ENTRY DATE: 2019-04-01
  ref <313>: RELEVANT RESIDUES IN SEQ ID NO: (1)..(453)
tttcatgagagtttgatcctggctcaggacgaacgctggcggcatgcctaatacatgcaagtcgaacgaaccgacggagaaacttgtttctcttgacgtgagtggcggacgggtgagtaacacgtgggaaacctaccctctagcgggggataactatcggaaacggtagctaataccgcataaaccttaagctcgcatgagtttgagttgaaagacggcttttgctgtcactagaggatggtcccgcggtgcattagttagttggtggggtaacggcctaccaagacgatgatgcatagccgacctgagagggtgatcggccacactgggactgagacacggcccagactcctacgggaggcagcagtagggaatcttccgcaatgggcgcaagcctgacggagcaatgccgcgtgtgtgaagaaggtcttcggatcgtaaagcactgttatt

SEQ ID NO: 3867 - DNA, 1557 bp, Facklamia sp. HMSC062C11
  ref <308>: DATABASE ACCESSION NUMBER: NCBI ACCESSION: NZ_KV802388.1
  ref <309>: DATABASE ENTRY DATE: 2019-04-01
  ref <313>: RELEVANT RESIDUES IN SEQ ID NO: (1)..(1557)
tttcatgagagtttgatcctggctcaggacgaacgctggcggcgtgcctaatacatgcaagtcgaacgaacggagctaggaacttgttcccggcaaagttagtggcgcacgggtgagtaacacgtggagaacctacccttttgcgggggataaccattggaaacgatgactaataccgcatagaatcgcagatcgcatgatcaacgaaggaaagacggcttcggctgtcacaaaaggatggctccgcggtgcattagctagatggtggggtaacggcctaccatggcaatgatgcatagccgacctgagagggtgatcggccacattgggactgagacacggcccaaactcctacgggaggcagcagtagggaatcttccgcaatgggcgcaagcctgacggagcaacgccgcgtgtgtgaagaaggtcttcggatcgtaaagcactgttgttagagaagaacgaccgctagagtaactgttagcggagtgacggtatctaaccagaaagccacggctaactacgtgccagcagccgcggtaatacgtaggtggcaagcgttgtccggatttattgggcgtaaagggagcgcaggcggtgacttaagtctgatgtgaaagcccacggctcaaccgtggagggtcattggaaactgggtcacttgagtgcagaagaggaaagtggaattccatgtgtagcggtgaaatgcgtagatatatggaggaacaccagtggcgaaggcgactttctggtctgtaactgacgctgaggctcgaaagcgtggggagcaaacaggattagataccctggtagtccacgccgtaaacgatgagtgctaagtgttggagggtttccacccttcagtgctggagttaacgcaataagcactccgcctggggagtacggccgcaaggctgaaactcaaaggaattgacggggacccgcacaagcggtggagcatgtggtttaattcgaagcaacgcgaagaaccttaccaggtcttgacatctcttgcatagcctagagataggtgaagcccttcggggcaagaagacaggtggtgcatggttgtcgtcagctcgtgtcgtgagatgttgggttaagtcccgcaacgagcgcaacccttatcactagttgccagcattcagatggggactctagtgagactgccggtgacaaaccggaggaaggtggggatgacgtcaaatcatcatgccccttatgacctgggctacacacgtgctacaatggatggtacaacgagcagcgaactcgcaagggcaagcgaatctcttaaagccattctcagttcggattgttctctgcaactcgagaacatgaagccggaatcgctagtaatcgcggatcagcacgccgcggtgaatacgttcccgggtcttgtacacaccgcccgtcacaccacgagagtttgtaacacccgaagccggtggcctaactttatgagggagccgtcgaaggtgggacagatgattggggtgaagtcgtaacaaggtagccgtatcggaaggtgcggctggatcacctcctttctaagga

SEQ ID NO: 3868 - DNA, 1556 bp, Facklamia sp. Marseille-P5643
  ref <308>: DATABASE ACCESSION NUMBER: NCBI ACCESSION: NZ_UWPC01000018.1
  ref <309>: DATABASE ENTRY DATE: 2019-04-01
  ref <313>: RELEVANT RESIDUES IN SEQ ID NO: (1)..(1556)
tttcatgagagtttgatcctggctcaggatgaacgctggcggcgtgcctaatacatgcaagtcgaacgaacggagatggagcttgctccatcaaagttagtggcgcacgggtgagtaacacgtggggaacctaccctctggcgggggataacagtcggaaacgattgctaagaccgcatagaacggtaagtcacatggctaaccgaggaaaaatggcttttgctattaccagaggatggccccgcggtgcattagttagttggtagggtaacggcctaccaagacgatgatgcatagccgacctgagagggtgatcggccacattgggactgagacacggcccaaactcctacgggaggcagcagtagggaatcttccgcaatgggcgaaagcctgacggagcaacgccgcgtgagtgaagaaggtcttcggatcgtaaagctctgttgttagagaagaacggcttctatagtaactgataggagtgtgacggtatctaaccagaaagccacggctaactacgtgccagcagccgcggtaatacgtaggtggcaagcgttatccggatttattgggcgtaaagggagcgcaggcggtgacttaagtctgatgtgaaagcccacggctcaaccgtggagggtcattggaaactgggtcacttgagtgcagaagaggaaagtggaattccatgtgtagcggtgaaatgcgtagatatatggaggaacaccagtggcgaaggcgactttctggtctgtaactgacgctgaggctcgaaagcgtggggagcaaacaggattagataccctggtagtccacgccgtaaacgatgagtgctaagtgttggagggtttccacccttcagtgctggagttaacgcaataagcactccgcctggggagtacgaccgcaaggttgaaactcaaaggaattgacggggacccgcacaagcggtggagcatgtggtttaattcgaagcaacgcgaagaaccttaccaggtcttgacatctgctgcatagcctagagataggtgaaatccttcgggacagcaagacaggtggtgcatggttgtcgtcagctcgtgtcgtgagatgttgggttaagtcccgcaacgagcgcaacccctataactagttgccagcattgagttggggactctagttagactgccggtgacaaaccggaggaaggtggggatgacgtcaaatcatcatgccccttatgacctgggctacacacgtgctacaatggatggtacaacgagcagcgaactcgcgagggtaagcgaatctctaaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagccggtggcctaaccattaggagggagccgtcgaaggtgggatagatgattggggtgaagtcgtaacaaggtagccgtatcggaaggtgcggctggatcacctcctttctaagga

SEQ ID NO: 3869 - DNA, 1323 bp, Faecalicatena contorta
  ref <308>: DATABASE ACCESSION NUMBER: NCBI ACCESSION: NZ_UHJJ01000034.1
  ref <309>: DATABASE ENTRY DATE: 2019-04-01
  ref <313>: RELEVANT RESIDUES IN SEQ ID NO: (1)..(1323)
gtggtaaaaactccggtggtatgagatggacccgcgtctgattagctagttggtaaggtaacggcttaccaaggcgacgatcagtagccggcctgagagggcgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctatgcaagtctggtgtgaaaacccggggctcaaccccgggactgcattggaaactgtgtggcttgagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgtatactaggtgtcgggtggcaaagccatccggtgccgcagcaaacgcaataagtataccacctggggagtacgttcgcaagaatgaaactcaaaggaattgacggggacccgcacaagcggtggagcatgtggtttaattcgaagcaacgcgaagaaccttacctgctcttgacatccccctgacaggcgcgtaatggtgccgttccttcgggacaggggagacaggtggtgcatggttgtcgtcagctcgtgtcgtgagatgttgggttaagtcccgcaacgagcgcaacccttatctttagtagccagcggtttggccgggcactctagagagactgccagggataacctggaggaaggcggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcaaatcagaatgttgcggtgaatacgttcccgggtcttgtacacaccgcccgtcacaccatgggagttggtaacgcccgaagtcagtgacccaaccgtaaggagggagctgccgaaggcgggactgatgactggggtgaagtcgtaacaaggtagccgtatcggaaggtgcggctggatcacctcctttctaaggaa

SEQ ID NO: 3870 - DNA, 1554 bp, Falsibacillus pallidus
  ref <308>: DATABASE ACCESSION NUMBER: NCBI ACCESSION: NZ_QQAY01000036.1
  ref <309>: DATABASE ENTRY DATE: 2019-04-01
  ref <313>: RELEVANT RESIDUES IN SEQ ID NO: (1)..(1554)
ttttcggagagtttgatcctggctcaggacgaacgctggcggcgtgcctaatacatgcaagtcgagcggattgatgggagcttgctccctgatatcagcggcggacgggtgagtaacacgtgggcaacctgcctgtaagactgggataactccgggaaaccggggctaataccggataattccttcctcctcctggaggaaggctgaaagatggtttcggctatcacttacagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggacggtacaaagggctgcaaaactgcaaagtcgagccaatcccataaaaccgttctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 3871 - DNA, 261 bp, Falsibacillus sp. GY 10110
  ref <308>: DATABASE ACCESSION NUMBER: NCBI ACCESSION: NZ_RCVZ01000023.1
  ref <309>: DATABASE ENTRY DATE: 2019-04-01
  ref <313>: RELEVANT RESIDUES IN SEQ ID NO: (1)..(261)
ttttcggagagtttgatcctggctcaggacgaacgctggcggcgtgcctaatacatgcaagtcgagcggactgatggggagcttgctcccctgacgtcagcggcggacgggtgagtaacacgtgggcaacctgcctgtaagactgggataacttcgggaaaccggagctaataccggataaccccttccccctcctgagggaaggttgaaagatggcttcggctatcacttacagatgggcccgcggcgcattagctagtt

SEQ ID NO: 3872 - DNA, 1469 bp, Falsirhodobacter deserti
  ref <308>: DATABASE ACCESSION NUMBER: NCBI ACCESSION: NZ_ML137218.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcgagatcttcggatctagcggcggacgggtgagtaacgcgtgggaacgtgcccttctctacggaatagcctcgggaaactgggagtaataccgtatacgccctttgggggaaagatttatcggagaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggatcagaaagtcagaggtgaaatcccagggctcaaccttggaactgcctttgaaactcctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcgggaccagagatggtcctttcagttcggctggataccacacaggtgctgcatggctgtcgtcagctcgtgtcgtgagatgttcggttaagtccggcaacgagcgcaacccacactctcagttgccatcattcagttgggcactctgggagaactgcccgtgataagcgggaggaaggtgtggatgacgtcaagtcctcatggcccttacgggttgggctacacacgtgctacaatggcgatgacaatgggccaatcccaaaaagtcgtctcagttcggattggggtctgcaactcgaccccatgaagtcggaatcgctagtaatcgcgtaacagcacgacgcggtgaatacgttcccgggccttgtacacaccgcccgtcacaccatgggaattgggtctacccgaaggtggtgcgccaaccagcaatgggggcagccaaccacggtaggctcagtgactggggtgaagtcgtaacaaggtagccgtaggggaacctgcggctggatcacctcctttctaa

SEQ ID NO: 3873 - DNA, 1468 bp, Falsirhodobacter sp. alg1
  ref <308>: DATABASE ACCESSION NUMBER: NCBI ACCESSION: NZ_BBJC02000001.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgagcgaagtcttcggacttagcggcggacgggtgagtaacgcgtgggaacatacccaaaggtacggaatagcctcgggaaactgggagtaataccgtatgtgcccttcgggggaaagatttatcgcctttggattggcccgcgttggattaggtagttggtgaggtaatggctcaccaagccgacgatccatagctggtttgagaggatgatcagccacactgggactgagacacggcccagactcctacgggaggcagcagtggggaatcttagacaatgggcgcaagcctgatctagccatgccgcgtgattgatgaaggccttagggttgtaaagatctttcagctgggaagataatgacggtaccagcagaagaagccccggctaactccgtgccagcagccgcggtaatacggagggggctagcgttgttcggaattactgggcgtaaagcgcacgtaggcggatcagaaagttgggggtgaaatcccggggctcaacctcggaacggcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggtagcatgctattcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggatatcgcggctctggagacagagctttcagttcggctggatatcacacaggtgctgcatggctgtcgtcagctcgtgtcgtgagatgttcggttaagtccggcaacgagcgcaacccacacccttagttgccatcattcagttgggcactctaggggaactgcccgtgataagcgggaggaaggtgtggatgacgtcaagtcctcatggcccttacgggttgggctacacacgtgctacaatggcgatgacaatgggctaatcccaaaaagtcgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgaaggcggtgcgccaaccagcaatggaggcagccgaccacggtaggttcagtgactggggtgaagtcgtaacaaggtagccgtaggggaacctgcggctggatcacctcctttcta

SEQ ID NO: 3874 - DNA, 1490 bp, Falsochrobactrum ovis
  ref <308>: DATABASE ACCESSION NUMBER: NCBI ACCESSION: NZ_QLMK01000037.1
  ref <309>: DATABASE ENTRY DATE: 2019-04-01
  ref <313>: RELEVANT RESIDUES IN SEQ ID NO: (1)..(1490)
tcaacatgagagtttgatcctggctcagaacgaacgctggcggcaggcttaacacatgcaagtcgaacgatctcttcggaggtagtggcagacgggtgagtaatgcatgggaatctacctttctctacggaataactcagggaaacttgtgctaataccgtatacgcccttttggggaaagatttatcggagaatgatgagcccatgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcgcgtaggcggattggtcagttaggggtgaaatcccagggctcaaccctggaactgcccttaatactgccagtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaactatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggttgcggatcgagagatcgatctttcagttcggctggaccggatacaggtgctgcatggctgtcgtcagctcgtgtcgtgagatgttgggttaagtcccgcaacgagcgcaaccctcgcctttagttgccatcatttagttgggcactctaaagggactgccagtgataagctggaggaaggtggggatgacgtcaagtcctcatggcccttacgggctgggctacacacgtgctacaatggtggtgacagtgggcagcgagatcgcaaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaag

SEQ ID NO: 3875 - DNA, 1491 bp, Falsochrobactrum sp. HN4
  ref <308>: DATABASE ACCESSION NUMBER: NCBI ACCESSION: NZ_QGDB01000004.1
  ref <309>: DATABASE ENTRY DATE: 2019-04-01
  ref <313>: RELEVANT RESIDUES IN SEQ ID NO: (1)..(1491)
tcaacatgagagtttgatcctggctcagaacgaacgctggcggcaggcttaacacatgcaagtcgaacgatctcttcggagatagtggcagacgggtgagtaatgcatgggaatctaccgttctctacggaataactcagggaaacttgtgctaataccgtatacgcccttttggggaaagatttatcggagaatgatgagcccatgttggattagctagttggtggggtaaaggcccaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcgcgtaggcggattggtcagttaggggtgaaatcccagggctcaaccctggaactgcctttaatactgccagtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaactatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggatcgagagatcgatctttcagttaggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 3876 - DNA, 1537 bp, Fastidiosibacter lacustris
  ref <308>: DATABASE ACCESSION NUMBER: NCBI ACCESSION: NZ_QLIR01000036.1
  ref <309>: DATABASE ENTRY DATE: 2019-04-01
  ref <313>: RELEVANT RESIDUES IN SEQ ID NO: (1)..(1537)
taaactgaagagtttgatcctggctcagattgaacgctggtggtatgcttaacacatgcaagtcgaacggggttagtagcttgctactggcttagtggcggacgggtgagtaacgcgtaggaatctgccgtatagagggggacaacagctggaaacggttgctaataccgcatgttacctgagggtaaaaggctgctttagggcagtcgctatacgatgagcctgcgttggattagctagttggtaaggtaaaggcttaccaaggcgatgatccatagctgttctgagaggaagatcagccacactgggactgagacacggcccagactcctacgggaggcagcagtggggaatattggacaatgggggcaaccctgatccagcaataccacgtgtgtgaagaaggccttagggttgtaaagcactttagtcactgaggaaggttattaggttaagagctagataacttgacgttaggtgaagaataagcaccggcaaactccgtgccagcagccgcggtaatacggagggtgcgagcgttaatcggaattactgggcgtaaagggttcgtaggtggttgaataagtcagatgtgaaagccctgggcttaacctgggaggtgcatatgatactgtttgactagagtttactagaggattggggaatttccggtgtagcggtgaaatgcgtagagatcgggaggaacatcgatggcgaaggcaacaatctggggttaaactgacactgagggacgaaagcgtggggatcaaacaggattagataccctggtagtccacgctgtaaacgatgagtactagctgttggatctggtgtaaaagatttagtggcgcagcaaacgcgataagtactccgcctggggaatacggccgcaaggttaaaactcaaaggaattgacggggacccgcacaagcggtggagcatgtggtttaattcgatgcaacgcgaagaaccttacctacccttgacatccacagaacggttgagagattgactggtgccttcgggaactgtgagacaggtgctgcatggctgtcgtcagctcgtgttgtgaaatgttgggttaagtcccgcaacgagcgcaacccttatttttagttgccagcattttggatgggcactctagagagactgccgctgataaggcggaggaaggtggggacgacgtcaagtcatcatggcccttacgggtagggctacacacgtgctacaatgggcattacagagggaggcgaaggggcgacctggagcgaaactcaagaaaggtgttcgtagtccggattgcactctgcaactcgagtgcatgaagtcggaatcgctagtaatcgcggatcagcatgccgcggtgaatacgttcccgggtcttgtacacaccgcccgtcacaccatgggagtgggttgcaaaagaagtaggtagcttaaccgttaggagggcgcttaccactttgtgattcatgactggggtgaagtcgtaacaaggtagccgtaggggaacctgcggctggatcacctccttaaa

SEQ ID NO: 3877 - DNA, 1543 bp, Fastidiosibacteraceae bacterium SYSU SYW-5
  ref <308>: DATABASE ACCESSION NUMBER: NCBI ACCESSION: NZ_QLIT01000111.1
  ref <309>: DATABASE ENTRY DATE: 2019-04-01
  ref <313>: RELEVANT RESIDUES IN SEQ ID NO: (1)..(1543)
taaactgaagagtttgatcctggctcagattgaacgctggtggcatgcttaacacatgcaagtcggacggcagcatggtagtgcttgcactactgatggcgagtggcggacgggtgagtaacgcgtaggaatctgccgtatagagggggacaacagttggaaacgactgctaataccgcatattatcttaggatgaagggtggcttttagctgccgctatacgatgagcctgcgttggattagctagttggttgggtaaaggctgaccaaggcgacgatccatagctgttctgagaggaagatcagccacactgggactgagacacggcccagactcctacgggaggcagcagtggggaatattggacaatgggggcaaccctgatccagcaatgccacgtgtgtgaagaaggccttagggttgtaaagcactttagtcactgaggaaattcatttggttaagagctgggtgaattgacgttaggtgaagaataagcaccggctaactccgtgccagcagccgcggtaatacggagggtgcgagcgttaatcggaattactgggcgtaaagggttcgtaggtggttgagtaagtcggatgtgaaatacctgggcttaacctgggaggtgcatacgatactgtttaactagagtttactagaggattggggaatttccggtgtagcggtgaaatgcgtagagatcgggaagaacatcgatggcgaaggcaacaatctggggttaaactgacactgagggacgaaagcgtgggtagcaaacaggattagataccctggtagtccacgctgtaaacgatgagtactagctgttggagtcggtgtaaaggctttagtggcgcagctaacgcgataagtactccgcctggggactacggccgcaaggttaaaactcaaaggaattgacggggacccgcacaagcggtggagcatgtggtttaattcgatgcaacgcgaagaaccttacctacccttgacatcctaagaacgaaccagagatggtttggtgccttcgggaacttagagacaggtgctgcatggctgtcgtcagctcgtgttgtgaaatgttgggttaagtcccgcaacgagcgcaacccttatttttagttgccagcatgtaaagatgggcactctagagagactgccgctgataaggcggaggaaggtggggacgacgtcaagtcatcatggcccttacgggtagggctacacacgtgctacaatgggtgttacagagggcagcgaagccgcgaggtggagcgaaactttgaaaggcactcttagtccggattgtactctgcaactcgagtgcatgaagtcggaatcgctagtaatcgcgaatcagcatgtcgcggtgaatacgttcccgggtcttgtacacaccgcccgtcacaccatgggagtgggttgctccagaagtagatagcttaaccgcaaggggggcgtttaccacggagtgattcatgactggggtgaagtcgtaacaaggtagccgtaggggaacctgcggctggatcacctccttaa

SEQ ID NO: 3878 - DNA, 1651 bp, Fastidiosibacteraceae bacterium SYSU SYW-6
  ref <308>: DATABASE ACCESSION NUMBER: NCBI ACCESSION: NZ_QLIU01000086.1
  ref <309>: DATABASE ENTRY DATE: 2019-04-01
  ref <313>: RELEVANT RESIDUES IN SEQ ID NO: (1)..(1651)
taaactgaagagtttgatcctggctcagattgaacgctggtggtatgcttaacacatgcaagtcgaacgggtttggaagacagaaaacagcagacagaagacggtaattttgagtgcggtgatgtgcacggattattttaaatttaaaataatcatcgcgaagcgatacaaatgatctgtcctccgtcttcagtcctctgttttccggctagtggcggacgggtgagtaacgcgtaggaatctgccgtacagagggggacaacagttggaaacggctgctaataccgcatgacaccttcgggtcaaaggttgcttaggcagtcgctgtacgatgagcctgcgttggattagctagttggttgggtaaaggctgaccaaggcgatgatccatagctgttctgagaggaagatcagccacactgggactgagacacggcccagactcctacgggaggcagcagtggggaatattggacaatgggggcaaccctgatccagcaataccacgtgtgtgaagaaggccttagggttgtaaagcactttagttcgtgaggaaggttatcatgttaagagctagataatttgacgttagcgaaagaataagcaccggctaactccgtgccagcagccgcggtaatacggagggtgcgagcgttaatcggaattactgggcgtaaagggttcgtaggtggttagataagtcagatgtgaaatacctgggctcaacctgggaggtgcatttgatactgtttgactagagttcactagaggattggggaatttccggtgtagcggtgaaatgcgtagagatcggaaggaacatcaatggcgaaggcaacaatctggggttgaactgacactgagggacgaaagcgtgggtagcaaacaggattagataccctggtagtccacgctgtaaacgatgagtactagctgttggatctggtgtaaaagatttagtggcgcagctaacgcgataagtactccgcctggggactacggccgcaaggttaaaactcaaaggaattgacggggacccgcacaagcggtggagcatgtggtttaattcgatgcaacgcgaagaaccttacctgcccttgacatccataggagatctgagagattggattgtgccttcgggaactatgagacaggtgctgcatggctgtcgtcagctcgtgttgtgaaatgttgggttaagtcccgcaacgagcgcaacccttatttttagttgccatcattaagttgggcactctagagagactgccgctgataaggcggaggaaggtggggacgacgtcaagtcatcatggcccttacgggcagggctacacacgtgctacaatgggcattacagagggaagcgaaggtgcgagctggagcgaaactttagaaaggtgttcgtagtccggattgctctctgcaactcgagagcatgaagtcggaatcgctagtaatcgcggatcagcatgccgcggtgaatacgttcccgggtcttgtacacaccgcccgtcacaccatgggagtgggttgcaaaagaagtagatagtctaaccgcaaggaggacgtttaccactttgtgattcatgactggggtgaagtcgtaacaaggtagccgtaggggaacctgcggctggatcacctccttaaa

SEQ ID NO: 3879 - DNA, 1546 bp, Ferriphaselus amnicola
  ref <308>: DATABASE ACCESSION NUMBER: NCBI ACCESSION: NZ_AP018738.1
  ref <309>: DATABASE ENTRY DATE: 2019-04-01
  ref <313>: RELEVANT RESIDUES IN SEQ ID NO: (1)..(1546)
gattgaactgaagagtttgatcctggctcagattgaacgctggcggcatgctttacacatgcaagtcgaacggattttggagcttgctccagagttagtggcgaacgggtgagtaatatatcggaacgtacccggcaatgggggataacgtagcgaaagttacgctaataccgcatatgccctgagggggaaagcaggggaccagtaatggccttgcgttgtcggagcggccgatatcggattagctagttggtgaggtaaaggctcaccaaggcgacgatccgtagcaggtctgagaggatgatctgccacactgggactgagacacggcccagactcctacgggaggcagcagtggggaattttggacaatgggcgaaagcctgatccagccatgccgcgtgagtgaagaaggccttcgggttgtaaagctctttcaggtggaaagaaaaggttacggataatacctgtgactgatgacggtaccatcagaagaagcaccggctaactacgtgccagcagccgcggtaatacgtagggtgcgagcgttaatcggaattactgggcgtaaagcgtgcgcaggcggttttgtaagacagacgtgaaagccccgggcttaacctgggaacggcgtttgtgactgcaagactagagtatggcagaggggggtagaattccacgtgtagcagtgaaatgcgtagagatgtggaggaataccgatggcgaaggcagccccctgggtcaatactgacgctcatgcacgaaagcgtggggagcaaacaggattagataccctggtagtccacgccctaaacgatgtcaactaggtgttgggggaggagacttccttagtaccgcagctaacgcgtgaagttgaccgcctggggagtacggccgcaaggttaaaactcaaaggaattgacggggacccgcacaagcggtggattatgtggattaattcgatgcaacgcgaaaaaccttacctacccttgacatgccaagaagattccagagatgggattgtgctcgaaagagaacttggacacaggtgctgcatggctgtcgtcagctcgtgtcgtgagatgttgggttaagtcccgcaacgagcgcaacccttgtcattaattgccatcatttagttgggcactttaatgagactgccggtgataaaccggaggaaggtggggatgacgtcaagtcctcatggcccttatgggtagggcttcacacgtaatacaatggtcggtacagagggttgccaagccgcgaggtggagccaatcccagaaagccgatcgtagtccggattggagtctgcaactcgactccatgaagtcggaatcgctagtaatcgcggatcagcatgtcgcggtgaatacgttcccgggtcttgtacacaccgcccgtcacaccatgggagtggaatctggcagaagtaggtagcctaaccgtaaggagggcgcttaccacgctgggtttcatgactggggtgaagtcgtaacaaggtagccgtatcggaaggtgcggctggatcacctcctttctag

SEQ ID NO: 3880 - DNA, 1531 bp, Ferruginibacter sp. BO-59
  ref <308>: DATABASE ACCESSION NUMBER: NCBI ACCESSION: NZ_RJJR01000002.1
  ref <309>: DATABASE ENTRY DATE: 2019-04-01
  ref <313>: RELEVANT RESIDUES IN SEQ ID NO: (1)..(1531)
tggagagtttgatcctggctcaggatgaacgctagcggcaggcttaatacatgcaagtcgtggggcagcatggggtagcaatactctgatggcgaccggcaaacgggtgaggaacatgtacgcaaccttcctttaactggagaatagcccctcgaaagagggattaatactccgtaacatcccgacacagcattgtgacgggattatagctccggcggttaaagatgggcgtgcacctgattagatagttggcggggtaacggcccaccaagtctgcgatcagtaactggtgtgagagcacgaccagtcacacgggcactgagacacgggtccgactcctacgggaggcagcagtaaggaatattggtcaatggacgcaagtctgaaccagccatgccgcgtggaggattaaggccctctgggttgtaaactccttttatctgggaagaaatgtactttttcttgagtacttgacggtaccagaggaataagcaccggctaactccgtgccagcagccgcggtaatacggagggtgcaagcgttatccggattcactgggtttaaagggtgcgtaggtgggcaggtaagtcagtggtgaaatctccgggcttaacccggaaactgccgttgatactatttgtcttgaatattgtggaggtaagcggaatatgtcatgtagcggtgaaatgcttagatatgacatagaacaccaattgcgaaggcagcttactacacaatgattgacgctgaggcacgaaagcgtggggatcaaacaggattagataccctggtagtccacgccctaaacgatgattactcgacatacgcgatacactgtgtgtgtctgagcgaaagcattaagtaatccacctgggaagtacgttcgcaagaatgaaactcaaaggaattgacgggggtccgcacaagcggtggagcatgtggtttaattcgatgatacgcgaggaaccttacctgggctagaatgctgagtgaccgtgggtgaaagctcactttatagcaatatacacttagtaaggtgctgcatggctgtcgtcagctcgtgccgtgaggtgttgggttaagtcccgcaacgagcgcaacccctatcactagttgccatcaggtaatgctgggaactctagtgaaactgccgccgtaaggcgtgaggaaggaggggatgatgtcaagtcatcatggcctttatgcccagggctacacacgtgctacaatggggaggacaaagggttgctacctggtaacaggatgctaatctcaaaaaccttctctcagttcgaattgaggtctgcaactcgacctcatgaagctggaatcgctagtaatcgtatatcagcaatgatacggtgaatacgttcccggaccttgtacacaccgcccgtcaagccatggaagctgggtgtacctaaagtcggtaaccgcaaggagccgcctagggtaaaactagtaactggggctaagtcgtaacaaggtagccgtatcggaaggtgcggctggaatacctcctttttagag

SEQ ID NO: 3881 - DNA, 1422 bp, Fervidicella metallireducens
  ref <308>: DATABASE ACCESSION NUMBER: NCBI ACCESSION: NZ_AZQP01000123.1
  ref <309>: DATABASE ENTRY DATE: 2019-04-01
  ref <313>: RELEVANT RESIDUES IN SEQ ID NO: (1)..(1422)
ccttagcggcggacgggtgagtaacacgtgggcaacctgcctctaagagggggataacacagagaaatctgtgctaataccgcataaagctgggactttgcatgaagtaacagccaaaggagaaatccgcttagagatgggcccgcggcgcattagctagttggtgaggtaacggctcaccaaggcgacgatgcgtagccgacctgagagggtgatcggccacattggaactgagacacggtccagactcctacgggaggcagcagtggggaatattgcacaatgggggaaaccctgatgcagcaacgccgcgtgagcgacgaaggcctcgggttgtaaagctctgtcttcgctgaagaaacctgacggtaagcgaggaggaagccacggctaactacgtgccagcagccgcggtaatacgtaggtggcgagcgttgtccggaattattgggcgtaaaggatgcgtaggtggtagtttaagtgggatgtgaaatccctgggcttaacccaggaactgcattccaaactggactactagagtgcaggagaggaaagtggaattcctagtgtagcggtgaaatgcgtagagattaggaggaacaccagtggcgaaggcgactttctggactgtaactgacactgaggcatgaaagcgtggggagcaaacaggattagataccctggtagtccacgccgtaaacgatgagtactaggtgtagggagtcaaatctctgtgccgcagttaacacattaagtactccgcctgggaagtacgatcgcaagattaaaactcaaaggaattgacggggacccgcacaagcagcggagcatgtggtttaattcgaagcaacgcgaagaaccttaccaagacttgacatctcctgaatagcctagagataggtgaagcttcggggcaggaagacaggtggtgcatggttgtcgtcagctcgtgtcgtgagatgttgggttaagtcccgcaacgagcgcaacccctgtcgttagttgccatcattaagttgggcactctagcgagactgcgaggttaactcggaggaaggtggggatgacgtcaaatcatcatgccccttatgtcttgggctacacacgtgctacaatggccggtacagaaagaagcgaacccgtgagggggagcaaatctcaaaaaccggtcccagttcggattgtaggctgcaactcgcctacatgaagccggagttgctagtaatcgcggatcagcatgccgcggtgaatacgttcccgggtcttgtacacaccgcccgtcacaccatgagagtcggcaacacccgaagtcagtgggctaactcgaaagagaggcagctgccgaaggtggggtcgatgattggggtgaagtcgtaacaaggtagccgtaggagaacctgcggctggatcacctcctttcta

SEQ ID NO: 3882 - DNA, 1236 bp, Fervidicola ferrireducens
  ref <308>: DATABASE ACCESSION NUMBER: NCBI ACCESSION: NZ_LOED01000084.1
  ref <309>: DATABASE ENTRY DATE: 2019-04-01
  ref <313>: RELEVANT RESIDUES IN SEQ ID NO: (1)..(1236)
gtaaagaaagctgccttttaggtggcggtggtggatgggcctgcggcccatcagctagttggtgaggtaacggctcaccaaggcgacgacgggtagccggcctgagagggtgtacggccacactgggactgggacacggcccagactcctacgggaggcagcagtggggaatcttgggcaatgggggaaaccctgacccagcgacgccgcgtgggggaagaaggccttcgggttgtaaacccctgtcaccggggaagaggaaggacggtacccggggaggaagccccggctaactacgtgccagcagccgcggtaatacgtagggggcgagcgttgtccggaatcactgggcgtaaagggcgtgtaggcgggctagcaagttgcgggtaaaaacccagggctcaactctgggggagcctgcaaaactgctggtcttgagggcgggagaggagagtggaattcccggagtagcggtgaaatgcgtagataccgggaggaacaccagtggcgaaggcggctctctggaccgcacctgacgctgaggcgcgaaagctaggggagcgaacgggattagataccccggtagtcctagccgtaaacgatggtcactaggtgtgggcggtttaaaagccgtccgtgccgcagctaacgcaataagtgacccgcctggggagtacggccgcaaggttgaaactcaaaggaattgacgggggcccgcacaagcggtggagcatgtggtttaattcgaagcaacgcgaagaaccttaccaggccttgacatgcgggtggtagcgacccgaaaggggagcgaccctagccgtttaggttagggagcctgcacaggtggtgcatggttgtcgtcagctcgtgtcgtgagatgttgggttaagtcccgcaacgagcgcaacccctacctctagttgccagcgggtggagccgggcactctagagggactgccgccgacaaggcggaggaaggtggggatgacgtcaaatcatcatgccctttatggcctgggccacacacgtgctacaatggccggtacagcgggaggcgaaggcgcgagccggagcgaatccctaaaagccggtctcagttcggattgcaggctgcaactcgcctgcatgaaggcggaatcgctagtaatcgcggatcagcatgccgcggtgaatacgttcccgggccttgtacacaccgcccgtcacaccatgggagttggcaacacccgaagccgg

SEQ ID NO: 3883 - DNA, 1420 bp, Fervidobacterium thailandense
  ref <308>: DATABASE ACCESSION NUMBER: NCBI ACCESSION: NZ_LWAF01000031.1
  ref <309>: DATABASE ENTRY DATE: 2019-04-01
  ref <313>: RELEVANT RESIDUES IN SEQ ID NO: (1)..(1420)
gaaggctgcacagcggcggacgggtgcgtaacgcgtaggaacgtgcccctcggaggcggatagccgcgggaaactgcgggtaaaccgccatacgctcgggagaggaaaggccgaaaggcgccgagggagcggcctgcgtcccatcaggtagttggtggggtaatggcccaccaagccgacgacgggtagccggtctgagaggatggccggccacaagggcactgagacacgggccctactcctacgggaggcagcagtgggggatcttggacaatgggcgaaagcctgatccagcgacgccgcgtggaggaagaagcccttcggggtgtaaactccttttgtcggggaaaaaggtctgatggtacccgacgaataagccccggctaactacgtgccagcagccgcggtaatacgtagggggcgagcgttacccggaattactgggcgtaaagggtgcgtaggcggccccgtgtgtccggtgtaaaagcccacggctcaaccgtggatatgcgctggaaactgcggggcttgggtgcggcagaggcagacggaactgctggtgtaggggtgaaatccgtagatatcagcaggaacgccggtggagaagtcggtctgctgggccgtaaccgacgctgaggcacgaaagctaggggagcgaaccggattagatacccgggtagtcctagccgtaaacgatgctcactaggtgtggggcgtaaagctccgtgctgaagctaacgcgttaagtgagccgcctggggagtacgcccgcaagggtgaaactcaaaggaattgacgggggcccgcacaagcggtggagcgtgtggtttaattggaagctaagccaagaaccttaccagggcttgacatgctggtggtaccgagccgaaaggtgagggaccctgccgtttggtagggagccagcacaggtggtgcacggtcgtcgtcagctcgtgccgtgaggtgttgggttaagtcccgcaacgagcgcaacccctgcccttagttgccagcgcgtaaggcgggcactctaaggggactgccggcgacgagccggaggaaggaggggatgacgtcagatactcgtgccccttatgccctgggcgacacacgcgctacaatggggtggacagcgggacgcgagccagcaatggtgagcaaatcccttaaaccaccccccagttcagattgtgggctgcaacccgcccacatgaagccggaatcgctagtaatcgcggatcagccatgccgcggtgaatacgttcccgggccttgtacacaccgcccgtcaagccacccgagctgcgggcacccgaagacggtgacccttcggggcgccgttgagggtgaacgtggtgaggggggctaagtcgtaacaaggtaggtgtaccggaaggtgcgcctggatcacctcctttct

SEQ ID NO: 3884 - DNA, 1516 bp, Fibrisoma limi
  ref <308>: DATABASE ACCESSION NUMBER: NCBI ACCESSION: NZ_CAIT01000009.1
  ref <309>: DATABASE ENTRY DATE: 2019-04-01
  ref <313>: RELEVANT RESIDUES IN SEQ ID NO: (1)..(1516)
tttacaatggagagtttgatcctggctcaggatgaacgctagcggcaggcctaatacatgcaagtcgagcgggcagcaatgccagcggcaaacgggtgcgtaacgcgtaaacaacctgccccggattgggggatagcccggcgaaagctggggtaaacccgcatggtgctaatgggtggcatcactgattagctaaatatttatagatccgggaggggtttgcgtctgattagctggatggtggggtaacggcctaccatggccatgatcagtaggggttctgagaggattggcccccacacgggtactgagagacggacccgactcctacgggaggcagcagtagggaatattgggcaatggaggcaactctgacccagccatgccgcgtgcaggacgaaggcgctcagcgttgtaaactgcttttgcccgtgaagaaacgcagccctgcggggttgtttgccggtaacgggtgaataagcaccggctaactccgtgccagcagccgcggtaatacggagggtgcaagcgttgtccggatttattgggtttaaagggtgcgtaggtggtcctgtaagtctggtttgaaagctgggtgctcaacactcagatgtggctggatactgtgggacttgaatgaactggaggtcactggaacgggtcatgtagcggtgaaatgcatagatatgacccagaaccccgattgcgtaggcaggtgactacggtttgattgacactgaggcacgagagcatggggagcgaacaggattagataccctggtagtccatgccgtaaacgatgatgactggctgttgggtctttggactcagtggctgagcgaaagcgttaagtcatccacctggggagtacgccggcaacggtgaaactcaaaggaattgacgggggtccgcacaagcggtggagcatgtggtttaattcgatgatacgcgaggaaccttacctgggctagaatgcgcgtgaagtgggtggaaacatccgcgccccgcaaggggcacaaagcaaggtgctgcatggctgtcgtcagctcgtgccgtgaggtgttgggttaagtcccgcaacgagcgcaacccttatcgtatgttgccagcacgtaatggtggggactcatgcgagactgcctgcgcaagcagagaggaagggggggacgacgtcaagtcatcatggcccttacgtccagggcgacacacgtgctacaatggtcggtacagcgggtcacgatggggcaaccctgagtcaatcttgcaaagccggtcacagttcggattggggtctgcaacccgaccccatgaagctggaatcgctagtaatcgcgcatcagccatggcgcggtgaatacgttcccggaccttgtacacaccgcccgtcaagccatgggagttggggggacctgaagttcggggtaacaaccggacaagggtaaacccggcgactggggctaagtcgtaacaaggtagccgtaccggaaggtgcggctggaacatctcctttctggag

SEQ ID NO: 3885 - DNA, 1510 bp, Fibrisoma sp. HYT19
  ref <308>: DATABASE ACCESSION NUMBER: NCBI ACCESSION: NZ_QXED01000023.1
  ref <309>: DATABASE ENTRY DATE: 2019-04-01
  ref <313>: RELEVANT RESIDUES IN SEQ ID NO: (1)..(1510)
tttacaatggagagtttgatcctggctcaggatgaacgctagcggcaggcctaatacatgcaagtcgaacgggcagcaatgccagtggcaaacgggtgcgtaacgcgtaaacaacctgccccggattgggggatagcccggcgaaagctggggtaaacccgcatggttcttttctctggcatcaggggatagataaatattaatagatccgggaggggtttgcgtctgattagctagttggcggggtaagagcccaccaaggcgatgatcagtaggggttctgagaggattggcccccacacgggtactgagagacggacccgactcctacgggaggcagcagtagggaatattgggcaatggaggcaactctgacccagccatgccgcgtgcaggacgaaggcgctcagcgttgtaaactgcttttgcccgtgaagaaacgcagccctgcggggttgcctgccggtaacgggtgaataagcaccggctaactccgtgccagcagccgcggtaatacggagggtgcaagcgttgtccggatttattgggtttaaagggtgcgtaggtggtcctgtaagtctggtttgaaagctgggtgcttaacactcagatgtggctggatactgtgggacttgaatgaactggaggtcactggaacgggtcatgtagcggtgaaatgcatagatatgacccagaaccccgattgcgtaggcaggtgactacggtttgattgacactgaggcacgagagcatggggagcgaacaggattagataccctggtagtccatgccgtaaacgatgatgactggctgttggccttttgaggtcagtggctgagcgaaagcgttaagtcatccacctggggagtacgccggcaacggtgaaactcaaaggaattgacgggggtccgcacaagcggtggagcatgtggtttaattcgatgatacgcgaggaaccttacctgggctagaatgcgcgtgaaggtggtggaaacatcaccgtgtagcaatacacacaaagcaaggtgctgcatggctgtcgtcagctcgtgccgtgaggtgttgggttaagtcccgcaacgagcgcaacccttatcgtatgttgccagcacgtaatggtggggactcatgcgagactgcctgcgcaagcagagaggaagggggggacgacgtcaagtcatcatggcccttacgtccagggcgacacacgtgctacaatggtcggtacagcgggtcacgatggggcaaccctgagtcaatcttgcaaagccggtcacagttcggattggggtctgcaacccgaccccatgaagctggaatcgctagtaatcgcgcatcagccatggcgcggtgaatacgttcccggaccttgtacacaccgcccgtcaagccatgggagttggggggacctgaagttcggggtaacaaccggacaagggtaaacccggcgactggggctaagtcgtaacaaggtagccgtaccggaaggtgcggctggaacatctccttt

SEQ ID NO: 3886 - DNA, 1526 bp, Fibrobacter sp. UWRM
  ref <308>: DATABASE ACCESSION NUMBER: NCBI ACCESSION: NZ_PVTU01000052.1
  ref <309>: DATABASE ENTRY DATE: 2019-04-01
  ref <313>: RELEVANT RESIDUES IN SEQ ID NO: (1)..(1526)
aatgaagagtttgatcctggctcagaacgaacgctggtggagtgtcttatacatgcaagtcgagcgaggacgtagcaatacgagccgagcggcgaatgggtgagtaacgcgtaagcaatctgccctgcattccggaacaaccgtgccaacgcgcggctaatgccgggagtcgtggtagtccacatggacgattgacgaaagatttatcgatgcaggatgagcttgcgtccgattagctagttggcggggtaacggcccaccaaggcgacgatcggtagccggcctgagagggcgatcggccacattgggactgagagacggcccagactcctacgggaggcagcagtagggaatattgcgcaatgggggcaaccctgacgcagcaactccacgtgtgggatgacgcatttcggtgtgtaaaccactgtcgagagggaataaggcgcagtttcgactgcgttgaatgtacctttaaaggaagcaccggcaaacttcgtgccagcagccgcggtaatacgaggggtgcaagcgttgttcggaatcactgggcgtaaagggagcgtaggcggatagtcaagcgttctgtgcaatctcggggcccaaccccgaacacgcagagcgaactgattatcttgagtagttcagaggttggcggaattcctggtgtagcggtggaatgcgtagatatcaggaagaacaccgatggcgaaggcagccaactggggactaactgacgctgaggctcgaaggcgcgggtagcaaacaggattagataccctggtagtccgcgcggtaaacgatgcatactagacgttccggagcaattcggggtgtcgcagttaacgcgttaagtatgccgcctggggagtacgtacgcaagtatgaaactcaaaggaattgacgggggcccgcacaagcggtggagcatgtggtttaattcgacgcaacgcgcagaaccttaccagggtttgacatggaatcgccgcagcgagagatcgctgttttgcagcaatgcaacggttcacacaggtgctgcatggctgtcgtcagctcgtgtcgtgagatgttgggttaagtcccgcaacgagcgcaacccacgtttctagttgctacccgcaagggagctctctagagagactgccggggacaacccggaggaaggtgtggatgacgtcaagtcctcatggcccttacatcctgggctacacacgtgctacaatgggcgatacaatgggcagcgaagtcgcgagactgagctaatcctgaaagtcgtcctcagttcggatcggagtctgcaactcgactccgtgaagctggaatcgctagtaatcgtgggtcagcacaccacggtgaatacgttcccgggccttgtacacaccgcccgtcaagccatggaagaagggagtgctctaagtcgtgatgccaacccgcaagggagccagcgcctaaagcaagacctttgactggggctaagtcgtaacaaggtagccgtaccggaaggtgcggctggattacctcctttaagg

SEQ ID NO: 3887 - DNA, 1526 bp, Fibrobacter sp. UWS4
  ref <308>: DATABASE ACCESSION NUMBER: NCBI ACCESSION: NZ_QGHD01000051.1
  ref <309>: DATABASE ENTRY DATE: 2019-04-01
  ref <313>: RELEVANT RESIDUES IN SEQ ID NO: (1)..(1526)
aatgaagagtttgatcctggctcagaacgaacgctggtggagtgtcttatacatgcaagtcgagcgaggacgtagcaatacgagccgagcggcgaatgggtgagtaacgcgtaagcaatctgccctgcattccggaacaaccgtgccaacgcgcggctaatgccgggagtcgtggtagtccacatggacgattgacgaaagatttatcgatgcaggatgagcttgcgtccgattagctagttggcggggtaacggcccaccaaggcgacgatcggtagccggcctgagagggcgatcggccacattgggactgagagacggcccagactcctacgggaggcagcagtagggaatattgcgcaatgggggcaaccctgacgcagcaactccacgtgtgggatgacgcatttcggtgtgtaaaccactgtcgagagggaataaggcgcagtttcgactgcgttgaatgtacctttaaaggaagcaccggcaaacttcgtgccagcagccgcggtaatacgaggggtgcaagcgttgttcggaatcactgggcgtaaagggagcgtaggcggatagtcaagcgttctgtgcaatctcggggcccaaccccgaacacgcagagcgaactgattatcttgagtagttcagaggttggcggaattcctggtgtagcggtggaatgcgtagatatcaggaagaacaccgatggcgaaggcagccaactggggactaactgacgctgaggctcgaaggcgcgggtagcaaacaggattagataccctggtagtccgcgcggtaaacgatgcatactagacgttccggagcaattcggggtgtcgcagttaacgcgttaagtatgccgcctggggagtacgtacgcaagtatgaaactcaaaggaattgacgggggcccgcacaagcggtggagcatgtggtttaattcgacgcaacgcgcagaaccttaccagggtttgacatggaatcgccgcagcgagagatcgctgttttgcagcaatgcaacggttcacacaggtgctgcatggctgtcgtcagctcgtgtcgtgagatgttgggttaagtcccgcaacgagcgcaacccacgtttctagttgctacccgcaagggagctctctagagagactgccggggacaacccggaggaaggtgtggatgacgtcaagtcctcatggcccttacatcctgggctacacacgtgctacaatgggcgatacaatgggcagcgaagtcgcgagactgagctaatcctaaaagtcgtcctcagttcggatcggagtctgcaactcgactccgtgaagctggaatcgctagtaatcgtgggtcagcacaccacggtgaatacgttcccgggccttgtacacaccgcccgtcaagccatggaagaagggagtgctctaagtcgtgatgccaacccgcaagggagccagcgcctaaagcaagacctttgactggggctaagtcgtaacaaggtagccgtaccggaaggtgcggctggattacctcctttaagg

SEQ ID NO: 3888 - DNA, 1558 bp, Fictibacillus aquaticus
  ref <308>: DATABASE ACCESSION NUMBER: NCBI ACCESSION: NZ_NOII01000042.1
  ref <309>: DATABASE ENTRY DATE: 2019-04-01
  ref <313>: RELEVANT RESIDUES IN SEQ ID NO: (1)..(1558)
tttattggagagtttgatcctggctcaggatgaacgctggcggcgtgcctaatacatgcaagtcgagcgaatgatgaggagcttgctcctctgatttagcggcggacgggtgagtaacacgtgggtaacctgcctgtaagatggggataactccgggaaaccggggctaataccgaataataaaagaagaagcatttcttctttttgaaagttggtttcggctaacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttcggcaatgggcgaaagcctgaccgagcaacgccgcgtgagcgaggaaggccttcgggtcgtaaagctctgttgtcagggaagaacaagtacgagagtaactgctcgtaccttgacggtacctgaccagaaagccacggctaactacgtgccagcagccgcggtaatacgtaggtggcaagcgttatccggaattattgggcgtaaagcgcgcgcaggcggtctcttaagtctgatgtgaaagcccacggctcaaccgtggagggtcattggaaactgggagacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacaggattagataccctggtagtccacgccgtaaacgatgagtgctaggtgttggggggttccaccctcagtgctgacgctaacgcattaagcactccgcctggggagtacggccgcaaggctgaaactcaaaggaattgacgggggcccgcacaagcagtggagcatgtggtttaattcgaagcaacgcgaagaaccttaccaggtcttgacatcctctgaccactctagagatagagctttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatgggtggtacaaagggttgcaaagccgcgaggccgagccaatcccaaaaagccactctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaacccttttgggagccagccgccgaaggtgggacagatgattggggtgaagtcgtaacaaggtagccgtatcggaaggtgcggctggatcacctcctttctatgga

SEQ ID NO: 3889 - DNA, 1558 bp, Fictibacillus arsenicus
  ref <308>: DATABASE ACCESSION NUMBER: NCBI ACCESSION: NZ_MQMF01000023.1
  ref <309>: DATABASE ENTRY DATE: 2019-04-01
  ref <313>: RELEVANT RESIDUES IN SEQ ID NO: (1)..(1558)
ttttatggagagtttgatcctggctcaggatgaacgctggcggcgtgcctaatacatgcaagtcgagcgaatgaagaggagcttgctcctctgatttagcggcggacgggtgagtaacacgtgggtaatctgcctgtaagacggggataactccgggaaaccggggctaataccggataataagaagaaacgcatgtttcttctttgaaagtcggtttcggctgacacttacagatgagcccgcggcgcattagctagttggtgaggtaacggctcaccaaggcgacgatgcgtagccgacctgagagggtgatcggccacactgggactgagacacggcccagactcctacgggaggcagcagtagggaatcttcggcaatgggcgaaagcctgaccgagcaacgccgcgtgagcgatgaaggccttcgggtcgtaaagctctgttgttagagaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtctcttaagtctgatgtgaaagcccacggctcaaccgtggagggtcattggaaactgggagacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacaggattagataccctggtagtccacgccgtaaacgatgagtgctaggtgttggggggttccaccctcagtgctgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctctgaccactctagagatagagctttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggttgcgaagccgcgaggccaagccaatcccaaaaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaacccttttgggagccagccgccgaaggtgggacagatgattggggtgaagtcgtaacaaggtagccgtatcggaaggtgcggctggatcacctcctttctatgga

SEQ ID NO: 3890 - DNA, 484 bp, Fictibacillus enclensis
  ref <308>: DATABASE ACCESSION NUMBER: NCBI ACCESSION: NZ_FMAV01000009.1
  ref <309>: DATABASE ENTRY DATE: 2019-04-01
  ref <313>: RELEVANT RESIDUES IN SEQ ID NO: (1)..(484)
tttattggagagtttgatcctggctcaggatgaacgctggcggcgtgcctaatacatgcaagtcgagcgaatgacgaggagcttgctcctctgatttagcggcggacgggtgagtaacacgtgggtaacctgcctgtaagacggggataactccgggaaaccggagctaataccggatgataacgagaagcgcctgcttcttttttgaaagtcggtttcggctgacgcttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttcggcaatggacgaaagtctgaccgagcaacgccgcgtgagcgatgaaggccttcgggtcgtaaagctctgttgtcagagaagaacaagtaccggagtaactgccggtac

SEQ ID NO: 3891 - DNA, 286 bp, Fictibacillus gelatini
  ref <308>: DATABASE ACCESSION NUMBER: NCBI ACCESSION: NZ_AUMP01000029.1
  ref <309>: DATABASE ENTRY DATE: 2019-04-01
  ref <313>: RELEVANT RESIDUES IN SEQ ID NO: (1)..(286)
tttattggagagtttgatcctggctcaggacgaacgctggcggcgtgcctaatacatgcaagtcgagcgaacggaaggagagcttgctctctggaagttagcggcggacgggtgagtaacacgtgggcaacctgcctcatagatggggataacaccgagaaatcggtgctaataccgaataatagagcggagcgcatgctccgcgcttgaaagtcggctttgagctgacactatgagatgggcccgcggcgcattagctagtaggtgaggtaacggctcacctagg

SEQ ID NO: 3892 - DNA, 1539 bp, Fictibacillus macauensis
  ref <308>: DATABASE ACCESSION NUMBER: NCBI ACCESSION: NZ_AKKV01000038.1
  ref <309>: DATABASE ENTRY DATE: 2019-04-01
  ref <313>: RELEVANT RESIDUES IN SEQ ID NO: (1)..(1539)
tttattggagagtttgatcctggctcaggatgaacgctggcggcgtgcctaatacatgcaagtcgagcgaacagatgagaagcttgcttctcagacgttagcggcggacgggtgagtaacacgtgggcaacctacctataagacggggataactccgggaaaccggggctaataccagataatcaagaagaacacctgtttttcttgtgaaagtcggtttcggctgacacttatagatgggcccgcggcgcattagctagttggtgaggtaacggctcaccaaggccacgatgcgtagccgacctgagagggtgatcggccacactgggactgagacacggcccagactcctacgggaggcagcagtagggaatcttcggcaatggacgaaagtctgaccgagcaacgccgcgtgagcgatgaaggccttcgggtcgtaaagctctgttgtcagagaagaacaagtatcggagtaactgccggtaccttgacggtacctgaccagaaagccacggctaactacgtgccagcagccgcggtaatacgtaggtggcaagcgttatccggaattattgggcgtaaagcgcgcgcaggcggttccttaagtctgatgtgaaagcccacggctcaaccgtggagggtcattggaaactggggaacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacaggattagataccctggtagtccacgccgtaaacgatgagtgctaggtgttggggggttccaccctcagtgctgacgttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgaccacttgagagatcaagctttccccttcgggggacagagtgacaggtggtgcatggttgtcgtcagctcgtgtcgtgagatgttgggttaagtcccgcaacgagcgcaacccttgaccttagttgccagcattcagttgggcactctagggtgactgccggtgacaaaccggaggaaggtggggatgacgtcaaatcatcatgccccttatgacctgggctacacacgtgctacaatgggtggtacaaagggttgcgaagccgcgaggctaagccaatcccaaaaagccactctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctgg

SEQ ID NO: 3893 - DNA, 1558 bp, Fictibacillus phosphorivorans
  ref <308>: DATABASE ACCESSION NUMBER: NCBI ACCESSION: NZ_CP015378.1
  ref <309>: DATABASE ENTRY DATE: 2019-04-01
  ref <313>: RELEVANT RESIDUES IN SEQ ID NO: (1)..(1558)
ttttatggagagtttgatcctggctcaggatgaacgctggcggcgtgcctaatacatgcaagtcgagcgaatgatgaggagcttgctcctctgatttagcggcggacgggtgagtaacacgtgggtaatctgcctgtaagacggggataactccgggaaaccggagctaataccggataataagagaagaagcatttcttctttttgaaagtcggtttcggctgacacttacagatgagcccgcggcgcattagctagttggtgaggtaacggctcaccaaggcgacgatgcgtagccgacctgagagggtgatcggccacactgggactgagacacggcccagactcctacgggaggcagcagtagggaatcttcggcaatgggcgaaagcctgaccgagcaacgccgcgtgagcgatgaaggccttcgggtcgtaaagctctgttgttagagaagaacaagtacgagagtaactgctcgtaccttgacggtacctaaccagaaagccacggctaactacgtgccagcagccgcggtaatacgtaggtggcaagcgttatccggaattattgggcgtaaagcgcgcgcaggcggtctcttaagtctgatgtgaaagcccacggctcaaccgtggagggtcattggaaactgggagacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacaggattagataccctggtagtccacgccgtaaacgatgagtgctaggtgttggggggttccaccctcagtgctgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctttgaccactctagagatagagctttccccttcgggggacaaagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatgatacaaagggttgcgaagccgcgaggccaagccaatcccaaaaagtcattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaacccttttgggagccagccgccgaaggtgggacagatgattggggtgaagtcgtaacaaggtagccgtatcggaaggtgcggctggatcacctcctttctatgga

SEQ ID NO: 3894 - DNA, 258 bp, Fictibacillus solisalsi
  ref <308>: DATABASE ACCESSION NUMBER: NCBI ACCESSION: NZ_FNHW01000006.1
  ref <309>: DATABASE ENTRY DATE: 2019-04-01
  ref <313>: RELEVANT RESIDUES IN SEQ ID NO: (1)..(258)
tttattggagagtttgatcctggctcaggacgaacgctggcggcgtgcctaatacatgcaagtcgagcggacagatgaggagcttgctcctctgatgttagcggcggacgggtgagtaacacgtgggcaacctacctgtaagacggggataactccgggaaaccggagctaataccggataataaagagaaacgcctgtttcttttttgaaagtcggtttcggctgacacttacagatgggcccgcggcgcattagct

SEQ ID NO: 3895 - DNA, 1554 bp, Fictibacillus sp. FJAT-27399
  ref <308>: DATABASE ACCESSION NUMBER: NCBI ACCESSION: NZ_LMVC01000002.1
  ref <309>: DATABASE ENTRY DATE: 2019-04-01
  ref <313>: RELEVANT RESIDUES IN SEQ ID NO: (1)..(1554)
tttattggagagtttgatcctggctcaggatgaacgctggcggcgtgcctaatacatgcaagtcgagcggaccaaagagagcttgctctctgaggttagcggcggacgggtgagtaacacgtgggtaacctgcctgtaagacggggataacttcgggaaaccgaagctaataccggatgataaagagaaacgcctgtttcttttttgaaagtcggccttgtgctgacgcttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttcggcaatggacgaaagtctgaccgagcaacgccgcgtgagcgatgaaggccttcgggtcgtaaagctctgttgtcagagaagaacaagtaccggagtaactgccggtaccttgacggtacctgaccagaaagccacggctaactacgtgccagcagccgcggtaatacgtaggtggcaagcgttatccggaattattgggcgtaaagcgcgcgcaggcggttctttaagtctgatgtgaaagcccacggctcaaccgtggagggtcattggaaactggggaacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacaggattagataccctggtagtccacgccgtaaacgatgagtgctaggtgttggggggttccaccctcagtgctgacgttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctctgaccatcctagagataggactttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatgggtggtacaaagggttgcaaagccgcgaggccgagccaatcccaaaaagccactctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttaggagccagccgccgaaggtgggacagatgattggggtgaagtcgtaacaaggtagccgtatcggaaggtgcggctggatcacctcctttcta

SEQ ID NO: 3896 - DNA, 1556 bp, Fictibacillus sp. S7
  ref <308>: DATABASE ACCESSION NUMBER: NCBI ACCESSION: NZ_QJKL01000001.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatgacgaggagcttgctcctctgatttagcggcggacgggtgagtaacacgtgggtaacctgcctgtaagacggggataactccgggaaaccggagctaataccggatgataacgagaagcgcctgcttcttttttgaaagtcggtttcggctgacgcttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttcggcaatggacgaaagtctgaccgagcaacgccgcgtgagcgatgaaggccttcgggtcgtaaagctctgttgtcagagaagaacaagtaccggagtaactgccggtaccttgacggtacctgaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactgggagacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacaggattagataccctggtagtccacgccgtaaacgatgagtgctaggtgttggggggttccaccctcagtgctgacgttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgaccacttgagagatcaagctttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatgggtggtacaaagggttgcgaagccgcgaggccgagccaatcccaaaaagccactctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgccgaaggtgggacagatgattggggtgaagtcgtaacaaggtagccgtatcggaaggtgcggctggatcacctcctttctatgga

SEQ ID NO: 3897 - DNA, 1271 bp, Filibacter sp. TB-66
  ref <308>: DATABASE ACCESSION NUMBER: NCBI ACCESSION: NZ_UXAV01000003.1
  ref <309>: DATABASE ENTRY DATE: 2019-04-01
  ref <313>: RELEVANT RESIDUES IN SEQ ID NO: (1)..(1271)
acgatgcgtagccgacctgagagggtgatcggccacactgggactgagacacggcccagactcctacgggaggcagcagtagggaatcttccacaatggacgaaagtctgatggagcaacgccgcgtgagcgaagaaggttttcggatcgtaaagctctgttgtaagggaagaacaagtacgggagtaactgcccgtgccatgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccactgaccggtgtagagatacacctttcccttcggggacagtggtgacaggtggtgcatggttgtcgtcagctcgtgtcgtgagatgttgggttaagtcccgcaacgagcgcaacccttgatcttagttgccaccattaagttgggcactctaaggtgactgccggtgacaaaccggaggaaggtggggatgacgtcaaatcatcatgccccttatgacctgggctacacacgtgctacaatggatgatacagagggttgccaacccgcgagggggagccaatcccataaaatcattcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 3898 - DNA, 1541 bp, Filifactor alocis
  ref <308>: DATABASE ACCESSION NUMBER: NCBI ACCESSION: NC_016630.1
  ref <309>: DATABASE ENTRY DATE: 2019-04-01
  ref <313>: RELEVANT RESIDUES IN SEQ ID NO: (1)..(1541)
aaacgaagagtttgatcctggctcaggatgaacgctggcggcgtgcttaacacatgcaagtcgaacgaacgactattaacagaacctttcggggcgaagatgatagaagttagtggcggacgggtgcgtaacgcgtgggtaatctgcctttgtcaaaggaataactattcgaaagaatagctaaaaccgtataacatattaatagggcatcctaataatatcaaaacgatagtggacaaagatgagcccgcgtctgattagctagttggtgagataaaagcccaccaaggcaacgatcagtagccgacctgagagggtgaacggccacattggaactgagacacggtccaaactcctacgggaggcagcagtggggaatattgcacaatggggggaaccctgatgcagcaacgccgcgtgagtgaagaaggcattcgtgtcgtaaaactctgtagtaggggaagaaagaaatgacagtaccctaaaagaaagccccggctaactacgtgccagcagccgcggtaatacgtagggggcaagcgttatccggaataactgggcgtaaagggtgcgcaggtggtttaacaagttagtggtgaaaggcataggctcaaccaatgtaagccattaaaactgtttaacttgagtgcaggagaggaaagtggaattcctagtgtagcggtgaaatgcgtagatattaggaggaataccagtggcgaaggcgactttctggactgcaactgacactgaggcacgaaagcgtggggagcaaacaggattagataccctggtagtccacgccgtaaacgatgagtactaggtgtcgggtgaagaactcggtgccgaagttaacacattaagtactccgcctggggagtacgctcgcaagagtaaaactcaaaggaattgacggggacccgcacaagcagcggagcatgtggtttaattcgaagcaacgcgaagaaccttacctaaacttgacataccaatgacagccttttaatcgaggacttttaccttcgggtagacaatggatacaggtggtgcatggttgtcgtcagctcgtgtcgtgagatgttgggttaagtcccgcaacgagcgcaacccttgtcgatagttaccagcagtaagatggggactctatcgagacagctaaggacaacttagaggaaggtggggatgacgtcaaatcatcatgccccttatgtttagggctacacacgtgctacaatggtcattacagagagaagcgaaactgcgaagtcaagcaaacctcaaaaagatgatccaagttcggattgtaggctgaaactcgcctacatgaagttggagttgctagtaatcgcgaatcagaatgtcgcggtgaatgcgttcccgggtcttgtacacaccgcccgtcacaccatgggagtttggggggcccaaagtcagcgactcaaccgcaaggagagagctgcccaaggcaaaacaaatgactggggtgaagtcgtaacaaggtagccgtatcggaaggtgcggctggatcacctcctttctaggga

SEQ ID NO: 3899 - DNA, 1536 bp, Filimonas sp. TTM-71
  ref <308>: DATABASE ACCESSION NUMBER: NCBI ACCESSION: NZ_SDHZ01000009.1
  ref <309>: DATABASE ENTRY DATE: 2019-04-01
  ref <313>: RELEVANT RESIDUES IN SEQ ID NO: (1)..(1536)
tacaatggagagtttgatcctggctcaggatgaacgctagcggcaggcttaatacatgcaagtcgaggggcagcaagttctagcaatagaatgttggcgaccggcaaacgggtgcggaacacgtacacaaccttcctttaagcggggcatagcccagagaaatttggagtaataccccatagaatgttaggatggcatcatctaaacattaaagatttatcacttaaagatgggtgtgcgtatgattaggtagttggcggggtaacggcccaccaagcctacgatcattagctgatgtgagagcatgatcagccacacgggcactgagacacgggcccgactcctacgggaggcagcagtaaggaatattggtcaatggacgcaagtctgaaccagccatgccgcgtgaaggatgacggtcctctggattgtaaacttcttttatcgaagacgaaatgtagattttctaatttacttgacggtactcgatgaataagcaccggctaactccgtgccagcagccgcggtaatacggagggtgcaagcgttatccggattcactgggtttaaagggtgcgtaggcgggtgtgaaagtcagtggtgaaatctcagagcttaactctgaaactgccattgatactctgcatcttgaattttctggaggttagcggaatatgtcatgtagcggtgaaatgcttagatatgacatagaacaccgattgcgaaggcagctgactacggatgaattgacgctgaggcacgaaagcgtggggatcaaacaggattagataccctggtagtccacgccctaaacgatggatactcgacatacgcgatacacagtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcatattgaccgtggatgaaagttcattttgtagcaatacacagtatgtaaggtgctgcatggctgtcgtcagctcgtgccgtgaggtgttgggttaagtcccgcaacgagcgcaacccctatctttagttgccatcaggttaagctgggaactctaaagaaactgccgtcgtaagacgcgaggaaggaggggatgatgtcaagtcatcatggcctttatgcccagggctacacacgtgctacaatggtaactacaaagagcagccacttggtgacaaggcgctaatctcaaaaaagttatctcagttcggatcggagtctgcaactcgactccgtgaagctggaatcgctagtaatcgtatatcagcaatgatacggtgaatacgttcccggaccttgcacacaccgcccgtcaagccatgaaagccggggggacctgaagtcggtaaccgcaaggaactgcctagggtaaaactggtaattggggctaagtcgtaacaaggtagccgtaccggaaggtgcggctggaatacctcctttttagag

SEQ ID NO: 3900 - DNA, 1534 bp, Filimonas sp. YR581
  ref <308>: DATABASE ACCESSION NUMBER: NCBI ACCESSION: NZ_QEOK01000017.1
  ref <309>: DATABASE ENTRY DATE: 2019-04-01
  ref <313>: RELEVANT RESIDUES IN SEQ ID NO: (1)..(1534)
acaatggagagtttgatcctggctcaggatgaacgctagcggcaggcttaatacatgcaagtcgaggggcagcacaggtagcaataccgggtggcgaccggcaaacgggtgcggaacacgtacacaaccttcctttaagcggggaatagcccagagaaatttggattaataccccatagtatattgattcggcatcggattgatattaaagatttatcacttaaagatgggtgtgcgttcgattaggtagttggcggggtaacggcccaccaagccttcgatcgatagctgatgtgagagcatgatcagccacacgggcactgagacacgggcccgactcctacgggaggcagcagtaaggaatattggtcaatggacgaaagtctgaaccagccatgccgcgtggaggatgaaggtcctctggattgtaaacttcttttatctggggcgaaacaacgcttttctaagcgtcttgacggtaccagatgaataagcaccggctaactccgtgccagcagccgcggtaatacggagggtgcaagcgttatccggattcactgggtttaaagggtgcgtaggcgggcatgtaagtcagtggtgaaatctcagagcttaactctgaaactgccattgatactatgtgtcttgaatttcctggaggttagcggaatatgtcatgtagcggtgaaatgcttagatatgacatagaacaccgattgcgaaggcagctgactataggtagattgacgctgatgcacgaaagcgtggggatcaaacaggattagataccctggtagtccacgccctaaacgatggatactcgacatacgcgatacacagtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcagtctgaccgtggatgaaagttcattttgtagcaatacacagattgtaaggtgctgcatggctgtcgtcagctcgtgccgtgaggtgttgggttaagtcccgcaacgagcgcaacccctatctttagttgccatcaggttaagctgggaactctaaagaaactgccgtcgtaagacgcgaggaaggaggggatgatgtcaagtcatcatggcctttatgcccagggctacacacgtgctacaatggtaactacaaagagctgctacctggtgacaggatgctaatctcaaaaaagttatctcagttcggatcgcagtctgcaactcgactgcgtgaagctggaatcgctagtaatcgtatatcagcaatgatacggtgaatacgttcccggaccttgcacacaccgcccgtcaagccatgaaagccggggggacctgaagtcggtaaccgcaaggaactgcctagggtaaaactggtaattggggctaagtcgtaacaaggtagccgtaccggaaggtgcggctggaatacctcctttttagagc

SEQ ID NO: 3901 - DNA, 1514 bp, Fimbriimonas ginsengisoli
  ref <308>: DATABASE ACCESSION NUMBER: NCBI ACCESSION: NZ_CP007139.1
  ref <309>: DATABASE ENTRY DATE: 2019-04-01
  ref <313>: RELEVANT RESIDUES IN SEQ ID NO: (1)..(1514)
ttcttcggagagtttgatcatggctcaggacgaacgctggcggcgtgcctaaaacatgcaagtcgaacgagggtagtaataccttagtggcgaacggcggagtaatacataagcaacgtgccccgaagactgggatatacagccgaaaggctgggcaataccggatgtgacggaagatcggcatcgattttccattaaacagttttttgcttcgggagcggcttatggcctatcaggtagttggtgaggtaacggctcaccaagccgacgacgggtagcgggtctgagaggatggtccgctcgagtgggactgagacacggcccacacacctacgggtggcagcagttgggaatcttgcacaatgggggaaaccctgatgcagcgacgccgcgtggaggacgaagggtctaggcctgtaaactccttttactcggaaagacttaggacggtaccgagtgaataaggaccggctaactacgtgccagcagccgcggtaagacgtagggtccaagcgttgtccggatttactgggcgtaaagagcgcgtaggcggctcgttaagtgtagagtgaaatctctgggctcaccccagaaaccgctgtgcatactggcgagctggagtgtcggagaggtatgtggaattcctggtgtagcggtgaaatgcgttgatatcaggaggaacacccatggcgaaggcagcatactggccgaccactgacgctgaggcgcgaaagcgtgggtagcaaacaggattagataccctggtagtccacgccctaaacgatggatactaggcgtaaggggtatcgaccccccttgtgccgcagctaacgcactaagtatcccgcctggggagtacggccgcaaggttgaaactcaaatgaattgacggggacccgcacaagcggtggagcatgtggattaattcgatactaaccgaagaaccttacccagacttgacatcgattgaaaagtccagaaatgggctcctccctcacaaggggacatgaagacacttgttgcatggctgtcgtcagctcgtgccgtgaggtgtacggttaagtccgccaacgagcgcaacccacgtcctgtgttaccagcgagaaagtcgggcactcacaggagaccgccggtgtaagccggaggaaggtgtggatgacgtcaagtcagcatggcagttacgtctggggcttcacacatgctacaatgggcgcaacagagggccgcgataccgcgaggtggagccaatcccaaaaatacgcccccagttcagattgcagtctgcaactcgactgcatgaaggcggaatcgctagtaaacgcaggtcagctatactgcgttgaatacgttcccgggtcttgtacacaccgcccgtcaagtcacttgaatcgtcttcacccgaagtccgtggcctaacccgcaagggaaggagcggccgaaggtgaggggggtaagagggactaagtcgtaacaaggtacccgtaccggaaggtgtgggtggatcacctccttaa

SEQ ID NO: 3902 - DNA, 1541 bp, Firmicutes bacterium AF12-30
  ref <308>: DATABASE ACCESSION NUMBER: NCBI ACCESSION: NZ_QTXP01000002.1
  ref <309>: DATABASE ENTRY DATE: 2019-04-01
  ref <313>: RELEVANT RESIDUES IN SEQ ID NO: (1)..(1541)
gaacatgagagtttgatcctggctcaggatgaacgctggcggcgtgcttaacacatgcaagtcgaacgaagcgccttatttgattttcttcggaactgaagatttggtgactgagtggcggacgggtgagtaacgcgtgggtaacctgccctgtacagggggataacaatcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatggggggaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagtgacaggtggtgcatggttgtcgtcagctcgtgtcgtgagatgttgggttaagtcccgcaacgagcgcaacccctatctttagtagccagcatttcaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaa

SEQ ID NO: 3903 - DNA, 1019 bp, Firmicutes bacterium AF22-6AC
  ref <308>: DATABASE ACCESSION NUMBER: NCBI ACCESSION: NZ_QUFW01000025.1
  ref <309>: DATABASE ENTRY DATE: 2019-04-01
  ref <313>: RELEVANT RESIDUES IN SEQ ID NO: (1)..(1019)
tttaacatgagagtttgatcctggctcaggatgaacgctggcggcgtgcctaacacatgcaagtcgaacggacttacattgaagcctagcgatatgtaagttagtggcggacgggtgagtaacgcgtgggtaacctgccttgtactgggggacaacagttggaaacgactgctaataccgcataagcgcacagcttcgcatgaagcagtgtgaaaaactccggtggtacaagatggacccgcgtctgattagctggttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcaggaaagaaaatgacggtacctgactaagaagccccggctaactacgtgccagcagccgcggtaatacgtagggggcaagcgttatccggatttactgggtgtaaagggagcgtagacggttttgcaagtctgaagtgaaagcccggggcttaaccccgggactgctttggaaactgtaggactagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgattactaggtgttggtgggtatgacccatcggtgccgcagcaaacgcaataagtaatccacctggggagtacgttcgcaagaatgaaactcaaaggaattgacggggacccgcacaagcggtggagcatgtggtttaattcgaagcaacgcgaagaaccttacctggtcttgacatcccgatgacagatctgtaatgagatccttacttcggtacatc

SEQ ID NO: 3904 - DNA, 702 bp, Firmicutes bacterium AF25-13AC
  ref <308>: DATABASE ACCESSION NUMBER: NCBI ACCESSION: NZ_QUFP01000124.1
  ref <309>: DATABASE ENTRY DATE: 2019-04-01
  ref <313>: RELEVANT RESIDUES IN SEQ ID NO: (1)..(702)
tcggtgtcgtcgcaaacgcaataagtattccacctggggagtacgttcgcaagaatgaaactcaaaggaattgacggggacccgcacaagcggtggagcatgtggtttaattcgaagcaacgcgaagaaccttacctgctcttgacatcccattcgatagagggtaatgcctctagcccttcgggggaatggagacaggtggtgcatggttgtcgtcagctcgtgtcgtgagatgttgggttaagtcccgcaacgagcgcaacccttattgtcagtagccagcaggtgaagctgggcactctgatgagactgccggggataacccggaggaaggtggggatgacgtcaaatcatcatgccccttatgagcagggctacacacgtgctacaatggcgtaaacagagggaagcgaaggagtgatctggagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggtaatgcccgaagtcagtgactcaaccgaaaggagagagctgccgaaggcaggactggtaactggggtgaagtcgtaacaaggtagccgtatcggaaggtgcggctggatcacctcctttctaaggaa

SEQ ID NO: 3905 - DNA, 1536 bp, Firmicutes bacterium AF36-3BH
  ref <308>: DATABASE ACCESSION NUMBER: NCBI ACCESSION: NZ_QUDS01000130.1
  ref <309>: DATABASE ENTRY DATE: 2019-04-01
  ref <313>: RELEVANT RESIDUES IN SEQ ID NO: (1)..(1536)
ttaaacgagagtttgatcctggctcaggacgaacgctggcggcgtgcctaacacatgcaagtcgaacgagaatctttgaacagatcttttcggagtgacgttcaaagaggaaagtggcggacgggcgagtaacgcgtgagtaacctgcccataagagggggataatccatggaaacgtggactaataccgcatattgtaattaagttgcatgacttgattatgaaagatttatcgcttatggatggactcgcgtcagattagatagttggtgaggtaacggctcaccaagtcaacgatctgtagccgaactgagaggttgatcggccgcattgggactgagacacggcccagactcctacgggaggcagcagtggggaatattgcgcaatgggggcaaccctgacgcagcaacgccgcgtgcaggaagaaggtctcggattgtaaactgttgtcgcaagggaagaagacagtgacggtaccttgtgagaaagtcacggctaactacgtgccagcagccgcggtaatacgtaggtgacaagcgttgtccggatttactgggtgtaaagggcgcgtaggcggactgtcaagtcagtcgtgaaataccggggcttaaccccggggctgcgattgaaactgacagccttgagtatcggagaggaaagcggaattcctagtgtagcggtgaaatgcgtagatattaggaggaacaccagtggcgaaggcggctttctggacgacaactgacgctgaggcgcgaaagtgtggggagcaaacaggattagataccctggtagtccacaccgtaaacgatggatactaggtgtaggaggtatcgaccccttctgtgccgcagttaacacaataagtatcccacctggggagtacgaccgcaaggttgaaactcaaaggaattgacgggggcccgcacaagcagtggagtatgtggtttaattcgaagcaacgcgaagaaccttacctgggcttgacatccctggaatcgagtagagatacttgagtgccttcgggaatcaggtgacaggtggtgcatggttgtcgtcagctcgtgtcgtgagatgttgggttaagtcccgcaacgagcgcaacccctattgtcagttgccatcattaagttgggcactctggcgagactgccggtgacaaatcggaggaaggtggggacgacgtcaaatcatcatgccccttatgcccagggctacacacgtactacaatggccgataacaaagtgcagcgaaaccgtgaggtggagcgaatcacaaaactcggtctcagttcagattgcaggctgcaactcgcctgcatgaagttggaattgctagtaatcgcggatcagaatgccgcggtgaatacgttcccgggccttgtacacaccgcccgtcacaccatgagagtcgataacacccgagcctgtgagctaacctattaggaggcagcagtcgaaggtggggttgatgattggggtgaagtcgtaacaaggtagccgtatcggaaggtgcggctggatcacctcctttct

SEQ ID NO: 3906 - DNA, 1539 bp, Firmicutes bacterium AM10-47
  ref <308>: DATABASE ACCESSION NUMBER: NCBI ACCESSION: NZ_QTUU01000009.1
  ref <309>: DATABASE ENTRY DATE: 2019-04-01
  ref <313>: RELEVANT RESIDUES IN SEQ ID NO: (1)..(1539)
tatcagagagtttgatcctggctcaggatgaacgctggcggcgtgcttaacacatgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacggtatcgcatgatacagtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctatcctcagtagccagcaggtgaagctgggcactctgtggagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttagggagggagctgccgaaggcgggattgataactggggtgaagtcgtaacaaggtagccgtatcggaaggtgcggctggatcacctcctttctaaggaa

SEQ ID NO: 3907 - DNA, 1563 bp, Firmicutes bacterium AM41-11
  ref <308>: DATABASE ACCESSION NUMBER: NCBI ACCESSION: NZ_QUIQ01000024.1
  ref <309>: DATABASE ENTRY DATE: 2019-04-01
  ref <313>: RELEVANT RESIDUES IN SEQ ID NO: (1)..(1563)
caaatggagagtttgatcctggctcaggatgaacgctggcggcatgcctaatacatgcaagtcgaacggagaagcctaacagaagatgcttgcatcggaagatagatacttctcagtggcgaacgggtgagtaacacgtaggtaacctgcccatgtgcccgggataatttctggaaacggaaactaaaaccggataggtaatagagaagcatttctgtattattaaagaagcctcaaagctttgaacatggatggacctgcggtgcattagctagttggtaaggtaacggcctaccaaggcgacgatgcatagccgacctgagagggcgaacggccacattgggactgagacacggcccaaactcctacgggaggcagcagtagggaattttcgtcaatggggggaaccctgaacgagcaatgccgcgtgagtgaagacggtcttcggattgtaaagctctgttgtgagagaaaaaggatatatataggaaatgatatgtatttgatggtatctcaccagaaagtcacggctaactacgtgccagcagccgcggtaatacgtaggtggcgagcgttatccggaatgattgggcgtaaagggtacgtaggcggcatgataagtctggagtgaaaggctacagctcaactgtagtatgctctggaaactgtcaagctagagtgcagaagagggcaatggaactccatgtgtagcggtaaaatgcgtagatatatggaagaacaccggtggcgaaggcggttgcctggtctgaaactgacgctgaagtacgaaagcgtggggagcaaataggattagataccctagtagtccacgccgtaaacgatgagaactaggtgttgggggaataactcagtgccgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatcccttgcagagatatagagatatatccgaggttatcaaggagacaggtggtgcatggttgtcgtcagctcgtgtcgtgagatgttgggttaagtcccgcaacgagcgcaacccttgtgatatgttaccaatattaagttagggactcatatcagactgccggtgataaaccggaggaaggtggggatgacgtcaaatcatcatgccccttatggcctgggctacacacgtactacaatggcggatacaaagggcagcgacagtgtgaactgaagcgaatcccataaagtccgtcccagttcggattggagtctgcaacccgactccatgaagttggaatcgctagtaatcgcgaatcagcatgtcgcggtgaatacgttctcgggccttgtacacaccgcccgtcaaaccatgggagtcagtaatacccgaagccggtggcctaacgcaagagggagccgtcgaaggtaggaccgatgactggggttaagtcgtaacaaggtatccctacgggaacgtggggatggatcacctcctttctaaggaga

SEQ ID NO: 3908 - DNA, 1537 bp, Firmicutes bacterium AM55-24TS
  ref <308>: DATABASE ACCESSION NUMBER: NCBI ACCESSION: NZ_QTVU01000091.1
  ref <309>: DATABASE ENTRY DATE: 2019-04-01
  ref <313>: RELEVANT RESIDUES IN SEQ ID NO: (1)..(1537)
ttaaacgagagtttgatcctggctcaggacgaacgctggcggcgtgcctaacacatgcaagtcgaacgagaatctttgaacagatcttttcggagtgacgttcaaagaggaaagtggcggacgggcgagtaacgcgtgagtaacctgcccataagagggggataatccatggaaacgtggactaataccgcatattgtaattaagttgcatgacttgattatgaaagatttatcgcttatggatggactcgcgtcagattagatagttggtgaggtaacggctcaccaagtcaacgatctgtagccgaactgagaggttgatcggccgcattgggactgagacacggcccagactcctacgggaggcagcagtggggaatattgcgcaatgggggcaaccctgacgcagcaacgccgcgtgcaggaagaaggtcttcggattgtaaactgttgtcgcaagggaagaagacagtgacggtaccttgtgagaaagtcacggctaactacgtgccagcagccgcggtaatacgtaggtgacaagcgttgtccggatttactgggtgtaaagggcgcgtaggcggactgtcaagtcagtcgtgaaataccggggcttaaccccggggctgcgattgaaactgacagccttgagtatcggagaggaaagcggaattcctagtgtagcggtgaaatgcgtagatattaggaggaacaccagtggcgaaggcggctttctggacgacaactgacgctgaggcgcgaaagtgtggggagcaaacaggattagataccctggtagtccacaccgtaaacgatggatactaggtgtaggaggtatcgaccccttctgtgccgcagttaacacaataagtatcccacctggggagtacgaccgcaaggttgaaactcaaaggaattgacgggggcccgcacaagcagtggagtatgtggtttaattcgaagcaacgcgaagaaccttacctgggcttgacatccctggaatcgagtagagatacttgagtgccttcgggaatcaggtgacaggtggtgcatggttgtcgtcagctcgtgtcgtgagatgttgggttaagtcccgcaacgagcgcaacccctattgtcagttgccatcattaagttgggcactctggcgagactgccggtgacaaatcggaggaaggtggggacgacgtcaaatcatcatgccccttatgcccagggctacacacgtactacaatggccgataacaaagtgcagcgaaaccgtgaggtggagcgaatcacaaaactcggtctcagttcagattgcaggctgcaactcgcctgcatgaagttggaattgctagtaatcgcggatcagaatgccgcggtgaatacgttcccgggccttgtacacaccgcccgtcacaccatgagagtcgataacacccgaagcctgtgagctaaccgtaaggaggcagcagtcgaaggtggggttgatgattggggtgaagtcgtaacaaggtagccgtatcggaaggtgcggctggatcacctcctttct

SEQ ID NO: 3909 - DNA, 1528 bp, Firmicutes bacterium AM59-13
  ref <308>: DATABASE ACCESSION NUMBER: NCBI ACCESSION: NZ_QUEU01000012.1
  ref <309>: DATABASE ENTRY DATE: 2019-04-01
  ref <313>: RELEVANT RESIDUES IN SEQ ID NO: (1)..(1528)
tttaacatgagagtttgatcctggctcaggatgaacgctggcggcgtgcctaacacatgcaagtcgaacggacttacattgaagcctagcgatatgtaagttagtggcggacgggtgagtaacgcgtgggtaacctgccttgtactgggggacaacagttggaaacgactgctaataccgcataagcgcacagcttcgcatgaagcagtgtgaaaaactccggtggtacaagatggacccgcgtctgattagctggttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcaggaaagaaaatgacggtacctgactaagaagccccggctaactacgtgccagcagccgcggtaatacgtagggggcaagcgttatccggatttactgggtgtaaagggagcgtagacggttttgcaagtctgaagtgaaagcccggggcttaaccccgggactgctttggaaactgtaggactagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgattactaggtgttggtgggtatgacccatcggtgccgcagcaaacgcaataagtaatccacctggggagtacgttcgcaagaatgaaactcaaaggaattgacggggacccgcacaagcggtggagcatgtggtttaattcgaagcaacgcgaagaaccttacctggtcttgacatccctatgaataacgggcaatgccgttagtacttcggtacataggagacaggtggtgcatggttgtcgtcagctcgtgtcgtgagatgttgggttaagtcccgcaacgagcgcaacccttatctttagtagccagcagtaagatgggcactctagagagactgccggggataacccggaggaaggtggggatgacgtcaaatcatcatgccccttatgaccagggctacacacgtgctacaatggcgtaaacaaagagaagcgaagtcgtgaggcagagcgaatctcaaaaataacgtctcagttcggattgtagtctgcaactcgactacatgaagctggaatcgctagtaatcgcagacagaatgctgcggtgaatacgttcccgggtcttgtacacaccgcccgtcacaccatgggagtcggaaatgcccgaagtcggtgacctaaccgcaaggaaggagccgccgaaggcaggtctgataactggggtgaagtcgtaacaaggtagccgtatcggaaggtgcggctggatcacctcctttctaaggaa

SEQ ID NO: 3910 - DNA, 1556 bp, Firmicutes bacterium I2511
  ref <308>: DATABASE ACCESSION NUMBER: NCBI ACCESSION: NZ_QXHL01000113.1
  ref <309>: DATABASE ENTRY DATE: 2019-04-01
  ref <313>: RELEVANT RESIDUES IN SEQ ID NO: (1)..(1556)
atttgagagtttgatcctggctcaggacgaacgctggcggcgtgcctaatacatgcaagtcgagcgcaaatttccggtgcttgcactggagagatgagcggcggacgggtgagtaacacgtgggtaatctacctttcagaccggaataacgcctggaaacgggtgctaatgccggataaggtggcggggaggcatcttcctgccaaaaaaggagctattgctccactgagagaggagcccgcggcgcattagctagttggcggggtaaaggcccaccaaggcgacgatgcgtagccgacctgagagggtggacggccacactgggactgagacacggcccagactcctacgggaggcagcagtagggaatcttccgcaatgggcgaaagcctgacggagcaacgccgcgtgagcgaggaaggccttcgggtcgtaaagctcagtcactcgggaagagcggtcctgggagtggaaaatccagggcgagacggtaccgagggaggaagccccggcaaactacgtgccagcagccgcggtaatacgtagggggcaagcgttgtccggaatcactgggcgtaaagggtgcgtaggcggtttggcaagtctggggtgaaaggccatggctcaaccatggtaatgccttggaaactgctaggcttgagtactggagaggcaaggggaattccacgtgtagcggtgaaatgcgtagatatgtggaggaataccagtggcgaaggcgccttgctggacagtgactgacgctgaggcacgaaagcgtggggagcaaacaggattagataccctggtagtccacgccgtaaacgatgagtgctaggtgttgggggggtcactcctcagtgccgaaggtaacccaataagcactccgcctggggagtacggtcgcaagactgaaactcaaaggaattgacgggggcccgcacaagcagtggagcatgtggtttaattcgaagcaacgcgaagaaccttaccagggcttgacatccctctgacgtctctagagatagagattccttcgggcagaggagacaggtggtgcatggttgtcgtcagctcgtgtcgtgagatgttgggttaagtcccgcaacgagcgcaacccttgatctgtgttaccagcatgtaaagatggggactcacaggtgactgccggcgtaagtcggaggaaggtggggatgacgtcaaatcatcatgcccttgatgtcctgggccacacacgtgctacaatgggcggaacaacgggacgcgagaccgcgaggtggagccaaaccctaaaaaccgttcgtagttcggattgcaggctgcaacccgcctgcatgaagccggaattgctagtaatcgcggatcagcatgccgcggtgaatccgttcccgggccttgtacacaccgcccgtcacaccacgagagttggcaacacccgaagtcggtggggtaacccgcaagggagccagccgccgaaggtggggtcgataattggggtgaagtcgtaacaaggtagccgtatcggaaggtgcggctggatcacctcctttctatggaga

SEQ ID NO: 3911 - DNA, 1511 bp, Fischerella major
  ref <308>: DATABASE ACCESSION NUMBER: NCBI ACCESSION: NZ_MRCA01000032.1
  ref <309>: DATABASE ENTRY DATE: 2019-04-01
  ref <313>: RELEVANT RESIDUES IN SEQ ID NO: (1)..(1511)
aaaacggagagtttgatcctggctcaggatgaacgctggcggtatgcttaacacatgcaagtcgaacgatgtagagacgtagcaatgctaggtctctacatagtggcggacgggtgagtaacgcgtgagaatctagcttcaggttcgggacaacattgggaaaccgatgctaataccggatgtgccgagaggtgaaaggcttgctgcctgaagaagagctcgcgtctgattagctagttggtggtgtaagggactaccaaggcgacgatcagtagctggtctgagaggatgatcagccacactggaactgagacacggtccagactcctacgggaggcagcagtggggaattttccgcaatgggcgaaagcctgacggagcaataccgcgtgagggaggaaggctcttgggttgtaaacctcttttctcaaggaagaagttctgacggtacttgaggaatcagcatcggctaactccgtgccagcagccgcggtaatacggaggatgcaagcgttatccggaatgattgggcgtaaagcgtccgcaggtggtggtgtgtgtctattgtcaaagcatcatgcttaacatgataaaggcagtagaaactacacgactagagtgcgttcggggcagagggaattcctggtgtagcggtgaaatgcgtagagatcaggaagaacaccggtggcgaaagcgctctgctaggccgcaactgacactgagggacgaaagctaggggagcgaatgggattagataccccagtagtcctagccgtaaacgatggatactaggcgttgagagtatcgaccctctcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtctggaacttcggtgaaagctgaaggtgccttcgggagccagaacacaggtggtgcatggctgtcgtcagctcgtgtcgtgagatgttgggttaagtcccgcaacgagcgcaaccctcgttcttagttgccagcacttcgggtgggcactctagggagactgccggtgacaaaccggaggaaggtggggatgacgtcaagtcagcatgccccttacgtcctgggctacacacgtactacaatgctcgagacaaagggcagcaagtatgcgaatacaagcaaatctcagaaactcgggctcagttcagatcgcaggctgcaactcgcctgcgtgaagtcggaatcgctagtaattgcaggtcagcatactgcagtgaattcgttcccgggccttgtacacaccgcccgtcacaccatggaagctggtcacgcccgaagtcgttaccctaaccgttcgcggagggggacgccgaaggtaggactggtgactggggtgaagtcgtaacaaggtagccgtaccggaaggtgtggctggatcacctccttttta

SEQ ID NO: 3912 - DNA, 1493 bp, Fischerella muscicola
  ref <308>: DATABASE ACCESSION NUMBER: NCBI ACCESSION: NZ_NRQW01000025.1
  ref <309>: DATABASE ENTRY DATE: 2019-04-01
  ref <313>: RELEVANT RESIDUES IN SEQ ID NO: (1)..(1493)
aaaacggagagtttgatcctggctcaggatgaacgctggcggtatgcttaacacatgcaagtcgaacggggcttttcggagcctagtggcggacgggtgagtaacgcgtgagaatctagcttcaggttcgggacaacattgggaaaccgatgctaataccggatgtgccgtgaggtaaaaggcttgctgcctgaagatgagctcgcgtctgattagctagttggtggtgtaagggactaccaaggcgacgatcagtagctggtctgagaggatgatcagccacactggaactgagacacggtccagactcctacgggaggcagcagtggggaattttccgcaatgggcgaaagcctgacggagcaataccgcgtgagggaggaaggctcttgggttgtaaacctcttttctcaaggaagaatcttgacggtacttgaggaatcagcatcggctaactccgtgccagcagccgcggtaatacggaggatgcaagcgttatccggaatgattgggcgtaaagcgtccgcaggtggttgtgtgtgtctattgtcaaagggtcatgcttaacatgataaaggcagtggaaactacacgactagagtgcgttcggggcagagggaattcctggtgtagcggtgaaatgcgtagagatcaggaagaacaccggtggcgaaagcgctctgctaggcctgcactgacactgagggacgaaagctaggggagcgaatgggattagataccccagtagtcctagccgtaaacgatggatactaggcgttgagagtatcgaccctctcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtctgggacttcggtgaaagctgaaggtgccttcgggagccagaacacaggtggtgcatggctgtcgtcagctcgtgtcgtgagatgttgggttaagtcccgcaacgagcgcaaccctcgttcttagttgccagcacttcgggtgggcactctagggagactgccggtgacaaaccggaggaaggtggggatgacgtcaagtcagcatgccccttacgtcctgggctacacacgtactacaatgctcgagacaaagggcagcaagcaggtaactgcaagcaaatctcataaactcgggctcagttcagatcgcaggctgcaactcgcctgcgtgaaggtggaatcgctagtaattgcaggtcagcatactgcggtgaattcgttcccgggccttgtacacaccgcccgtcacaccatggaagctggtcacgcccgaagtcgttaccctaaccgttcgcggggggggacgccgaaggtaggactggtgactggggtgaagtcgtaacaaggtagccgtaccggaaggtgtggctggatcacctccttttta

SEQ ID NO: 3913 - DNA, 1511 bp, Fischerella sp. NIES-3754; identical to SEQ ID NO: 3911
  ref <308>: DATABASE ACCESSION NUMBER: NCBI ACCESSION: NZ_AP017305.1
  ref <309>: DATABASE ENTRY DATE: 2019-04-01
  ref <313>: RELEVANT RESIDUES IN SEQ ID NO: (1)..(1511)

SEQ ID NO: 3914 - DNA, 1494 bp, Fischerella sp. PCC 9339
  ref <308>: DATABASE ACCESSION NUMBER: NCBI ACCESSION: NZ_JH992898.1
  ref <309>: DATABASE ENTRY DATE: 2019-04-01
  ref <313>: RELEVANT RESIDUES IN SEQ ID NO: (1)..(1494)
aaaacggagagtttgatcctggctcaggatgaacgctggcggtatgcttaacacatgcaagtcgaacgggctctttcgggggcaagtggcggacgggtgagtaacgcgtgagaatctggctctaggttcgggacaaccactggaaacggtggctaataccggatgtgccgagaggtgaaaggttaactgcctggagatgagctcgcgtctgattagctagttggtggtgtaagggactaccaaggcgacgatcagtagctggtctgagaggatgatcagccacactggaactgagacacggtccagactcctacgggaggcagcagtggggaattttccgcaatgggcgaaagcctgacggagcaataccgcgtgagggaggaaggctcttgggttgtaaacctcttttctcagggaataagcaagtgaaggtacctgaggaatcagcatcggctaactccgtgccagcagccgcggtaatacggaggatgcaagcgttatccggaatgattgggcgtaaagcgtccgtaggtagcagtgtgtgtctattgttaaagagtttggcttaaccaaataaaggcggtagaaactacacagctagagtgcgttcggggcagagggaattcctggtgtagcggtgaaatgcgtagagatcaggaagaacaccggtggcgaaagcgctctgctaggccgcaactgacactgagggacgaaagctaggggagcgaatgggattagataccccagtagtcctagccgtaaacgatggatactaggcgttgagagtatcgaccctctcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtctggaatcttggggaaactcaagagtgccttcgggagccagaacacaggtggtgcatggctgtcgtcagctcgtgtcgtgagatgttgggttaagtcccgcaacgagcgcaaccctcgtacttagttgccagcacttcgggtgggcactctaaggagactgccggtgacaaaccggaggaaggtggggatgacgtcaagtcagcatgccccttacgtcctgggctacacacgtactacaatgctacggacaaagggcagcgagactgcgaagttaagcaaatctcagaaaccgtagctcagttcagatcgcaggctgcaactcgcctgcgtgaaggaggaatcgctagtaattgcaggtcagcatactgcagtgaattcgttcccgggccttgtacacaccgcccgtcacaccatggaagctggtcacgcccgaagtcgttaccctaaccattatttggagggggacgccgaaggtaggactggtgactggggtgaagtcgtaacaaggtagccgtaccggaaggtgtggctggatcacctcctttt

SEQ ID NO: 3915 - DNA, 1493 bp, Fischerella sp. PCC 9431
  ref <308>: DATABASE ACCESSION NUMBER: NCBI ACCESSION: NZ_KE650771.1
  ref <309>: DATABASE ENTRY DATE: 2019-04-01
  ref <313>: RELEVANT RESIDUES IN SEQ ID NO: (1)..(1493)
aaaacggagagtttgatcctggctcaggatgaacgctggcggtatgcttaacacatgcaagtcgaacggtctcttcggagatagtggcggacgggtgagtaacgcgtgagaatctggctctaggtctgggacaaccactggaaacggtggctaataccggatgtgcctatgggtgaaaggttaactgcctggagatgagctcgcgtctgattagctagttggtggtgtaagagactaccaaggcgacgatcagtagctggtctgagaggatgatcagccacactggaactgagacacggtccagactcctacgggaggcagcagtggggaattttccgcaatgggcgaaagcctgacggagcaataccgcgtgagggaggaaggctcttgggttgtaaacctcttttctcaaggaagaatgatgacggtacttgaggaatcagcatcggctaactccgtgccagcagccgcggtaatacggaggatgcaagcgttatccggaatgattgggcgtaaagcgtccgtaggtggctgtgtgtgtctattgttaaagagtttggctcaaccaaataagggcggtagaaactacacagctagagtgcgttcggggcagagggaattcctggtgtagcggtgaaatgcgtagagatcaggaagaacaccggtggcgaaagcgctctgctaggccgcaactgacactgagggacgaaagctaggggagcgaatgggattagataccccagtagtcctagccgtaaacgatggatactaggcgttgagagtatcgaccctctcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtctggaatctctgggaaactagagagtgccttcgggagccagaacacaggtggtgcatggctgtcgtcagctcgtgtcgtgagatgttgggttaagtcccgcaacgagcgcaaccctcgtacttagttgccagcatttaggatgggcactctaaggagactgccggtgacaaaccggaggaaggtggggatgacgtcaagtcagcatgccccttacgtcctgggctacacacgtactacaatgctacggacaaagggcagcgagactgcgaagttaagcaaatctcagaaaccgtggctcagttcagatcgcaggctgcaactcgcctgcgtgaaggaggaatcgctagtaattgcaggtcagcatactgcagtgaattcgttcccgggccttgtacacaccgcccgtcacaccatggaagctggtcacgcccgaagtcgttaccctaactgttcgcagagggggatgccgaaggtaggactggtgactggggtgaagtcgtaacaaggtagccgtaccggaaggtgtggctggatcacctccttttaagg

SEQ ID NO: 3916 - DNA, 1491 bp, Fischerella sp. PCC 9605
  ref <308>: DATABASE ACCESSION NUMBER: NCBI ACCESSION: NZ_KI912148.1
  ref <309>: DATABASE ENTRY DATE: 2019-04-01
  ref <313>: RELEVANT RESIDUES IN SEQ ID NO: (1)..(1491)
aaaacggagagtttgatcctggctcaggatgaacgctggcggtatgcttaacacatgcaagtcgaacggacttcttcggaagttagtggcggacgggtgagtaacgcgtgagaatctggctctaggttcgggacaacattgggaaaccgatgctaataccggatgtgcctatgggtgaaagattaattgcctgaagatgagctcgcgtctgattagctagtaggtggggtaagagcccacctaggcgacgatcagtagctggtctgagaggatgatcagccacactggaactgagacacggtccagactcctacgggaggcagcagtggggaattttccgcaatgggcgaaagcctgacggagcaataccgcgtgagggaggaaggctcttgggttgtaaacctcttttctcaaggaagaaatttgacggtacttgaggaatcagcatcggctaactccgtgccagcagccgcggtaatacggaggatgcaagcgttatccggaatgattgggcgtaaagcgtccgtaggtggctgtgtaagtctattgtcaaagcgtcatgcttaacatgataagggcggtagaaactacacagctagagtgcattcggggcagagggaattcctggtgtagcggtgaaatgcgtagagatcaggaagaacaccggtggcgaaagcgctctgctaggctgcaactgacactgagagacgaaagctaggggagcgaatgggattagataccccagtagtcctagctgtaaacgatggatactaggcgttgcttgtatcgacccaagcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtccggaaccttgccgaaaggtgagggtgccttcgggagccggaacacaggtggtgcatggctgtcgtcagctcgtgtcgtgagatgttgggttaagtcccgcaacgagcgcaaccctcgttcttagttgccagcatttgggatgggcactctaggaagactgccggtgacaaaccggaggaaggcggggatgacgtcaagtcagcatgccccttacgtcctgggctacacacgtactacaatgctcgagacaaagggcagcgagccagcgatggcaagcaaatctcacaaactcgggctcagttcagatcgcaggctgcaactcgcctgcgtgaaggcggaatcgctagtaattgcaggtcagcatactgcagtgaattcgttcccgggccttgtacacaccgcccgtcacaccatggaagctggtcacgcccgaagtcgttaccctaactcttcggagagggggacgccgaaggtaggactggtgactggggtgaagtcgtaacaaggtagccgtaccggaaggtgtggctggatcacctcctttt

SEQ ID NO: 3917 - DNA, 1520 bp, Flammeovirga sp. L12M1
  ref <308>: DATABASE ACCESSION NUMBER: NCBI ACCESSION: NZ_CP034562.1
  ref <309>: DATABASE ENTRY DATE: 2019-04-01
  ref <313>: RELEVANT RESIDUES IN SEQ ID NO: (1)..(1520)
ggagagtttgatcctggctcaggatgaacgctagcggcaggcctaatacatgcaagtcgaggggtaacaggagtgcttgcacttgctgacgaccggcgcacgggtgcgtaacgcgtatataacttgcctttgtctggaagatagcccggagaaatccggattaatattccatggtatcttaagctcgcatgagttaaagattaaagatttatcggacagagatggatatgcgtcccattagctagttggtaaggtaacggcttaccaaggcaacgatgggtaggggttctgagaggaaggtcccccacactggcactgagatacgggccagactcctacgggaggcagcagtagggaatattgggcaatggaggcaactctgacccagccatgccgcgtgagtgatgaatgccttcgggttgtaaagctcttttgtatgggaagaaccacactcttgcgagagtgtctgacggtaccataagaataagcaccggctaactccgtgccagcagccgcggtaatacggagggtgcaagcgttgtccggaattattgggtttaaagggtgcgcaggtggctttataagtcagaggttaaagaccggggctcaactccgtgtttgcctttgatactgtaaggcttgaaatacgtatgggtaggcggaattcctcatgtagcggtgaaatgcacagatatgaggaggaagaccgaaggcgaaggcagcttactgggcgttatttgacactgaggcacgaaagcgtggggagcgaacaggattagataccctggtagtccacgccgtaaacgatgagaactcgacctgtgtggtgtaaccatgcgggtcccagcgaaagcgagaagttctccacctggggagtacgctggcaacagtgaaactcaaaggaattgacgggggtccgcacaagcggtggagcatgtggtttaattcgatgatacgcgaggaaccttacctggactcgaattcgttttgacaattctagagatagaactttcttcggacagaatggaaggtgctgcatggctgtcgtcagctcgtgccgcgaggtgttgggttaagtcccgcaacgagcgcaacccctacttctagttgccatcaggttatgctggggactctagaggaactgcctgcgcaagcagagaggaaggcggggacgacgtcaagtcatcatggcccttacgtccagggcaacacacgtgctacaatggtagggacaacgggcagcaagctagtgatagtaagcgaatctcgaaaaccctatcccagttcggattggagtctgcaactcgactccatgaagttggaatcgctagtaatcgcgcatcagctatggcgcggtgaatacgtacccggaccttgtacacaccgcccgtcaagccatggaagtttggtgggcctgaagatggtggccgtaataggagctatttagggcaaaacaaataactggggctaagtcgtaacaaggtagccgtaccggaaggtgcggctggaacacctccttt

SEQ ID NO: 3918 - DNA, 1533 bp, Flammeovirga sp. MY04
  ref <308>: DATABASE ACCESSION NUMBER: NCBI ACCESSION: NZ_CP003561.1
  ref <309>: DATABASE ENTRY DATE: 2019-04-01
  ref <313>: RELEVANT RESIDUES IN SEQ ID NO: (1)..(1533)
tttttacaacggagagtttgatcctggctcaggatgaacgctagcggcaggcctaatacatgcaagtcgaggggtaacatgatctgcttgcagattgatgacgaccggcgcacgggtgcgtaacgcgtatataacttgcctcatactggagaatagcccggagaaattcggattaatgctccatagtattataaagtagcatcgcttaataattaaagatttatcggtatgagatagatatgcgtcccattagctagttggtgcaggtaacggctcaccaaggcgacgatgggtaggggttctgagaggaaggtcccccacactggcactgagatacgggccagactcctacgggaggcagcagtagggaatattggtcaatggaggcaactctgaaccagccatgccgcgtgaacgatgaaggccttcgggtcgtaaagttcttttgtatgggaagaaacccacccctgcgggggtgtttgacggtaccataagaataagcaccggctaactccgtgccagcagccgcggtaatacggagggtgcaagcgttgtccggaattattgggtttaaagggtgcgcaggtggtcctgccagtcagaggttaaagaccggggcttaactccgcgtttgcctttgatactacaggacttgaaatacgtatgggtaggcggaattcctcatgtagcggtgaaatgcacagatatgaggaggaagaccgaaggcgaaggcagcttactgggcgttatttgacactgaggcacgaaagcgtggggagcgaacaggattagataccctggtagtccacgccgtaaacgatgagaactcggcttgtgtgcgttggcatgcgagcccaaagggaaaccgagaagttctccacctgggggagtacgccggcaacggtgaaactcaaaggaattgacgggggtccgcacaagcggtggagcatgtggtttaattcgatgatacgcgaggaaccttacctggactcgaattcgttttgaccgctttagagataaagctttcttcggacagaatgaaaggtgctgcatggctgtcgtcagctcgtgccgcgaggtgttgggttaagtcccgcaacgagcgcaacccctacttctagttgccatcaggttatgctggggactctagaggaactgcctgcgcaagcagagaggaaggcggggacgacgtcaagtcatcatggcccttacgtccagggcaacacacgtgctacaatggtggggacaatgagcagcaagctagtgatagttagcgaatctcaaaaacctcatcccagttcggattggagtctgcaactcgactccatgaagttggaatcgctagtaatcgcgcatcagctatggcgcggtgaatacgtacccggaccttgtacacaccgcccgtcaagccatggaagtttggtgggcctgaagacggtggccgttaaggagctgtttagggcaaaacaaataactggggctaagtcgtaacaaggtagccgtaccggaaggtgcggctggaacacctccttt

SEQ ID NO: 3919 - DNA, 1527 bp, Flammeovirgaceae bacterium 311
  ref <308>: DATABASE ACCESSION NUMBER: NCBI ACCESSION: NZ_CP004371.1
  ref <309>: DATABASE ENTRY DATE: 2019-04-01
  ref <313>: RELEVANT RESIDUES IN SEQ ID NO: (1)..(1527)
tacaatggagagtttgatcctggctcaggatgaacgctagcggcgggcctaatacatgcaagtcgagcggcaagattctttcggggatcctagagcggcgcacgggtgcgtaacgcgtatgcaacttaccctatactgggggatagcccggggaaacccggattaataccccatggcatcaaggattcgcatgatgacttgattaaagatttattggtataggatgggcatgcgtctgattagctagttggtagggtaacggcctaccaaggcgacgatcagtagggggtctgagaggatgatcccccacactggcactgagatacgggccagactcctacgggaggcagcagtagggaatattggtcaatgggcgagagcctgaaccagccacgccgcgtgaaggaagaaggcgttctgcgttgtaaacttcttttataggggaagaaaaaggagatgcgtctccaactgacggtaccctatgaataagcaccggctaactccgtgccagcagccgcggtaatacggagggtgcaagcgttgtccggatttattgggtttaaagggtgcgtaggcgggttagtaagtcagtggtgaaagccggcagctcaactgtcgaactgccattgatactgttaaccttgagtatagttgaggtaggcggaatggaaggtgtagcggtgaaatgcatagatatcttccagaacaccgatagcgtaggcagcttactaagctataactgacgctgaggcacgaaagcgtggggagcgaacaggattagataccctggtagtccacgccgtaaacgatgtacactcgctgttggcgatattacagtcagcggccaagcgaaagcgttaagtgtaccacctggggagtacgccggcaacggtgaaactcaaaggaattgacgggggtccgcacaagcggtggagcatgtggtttaattcgatgatacgcgaggaaccttacctgggctagaatgcccttgaccgccctggaaacagggttttccttcgggacaaggtgcaaggtgctgcatggctgtcgtcagctcgtgccgtgaggtgttgggttaagtcccgcaacgagcgcaacccctatgtttagttgccagcacgtaatggtggggactctaaacagactgcctgcgcaagcagagaggaaggaggggacgacgtcaagtcatcatggcccttacgcccagggctacacacgtgctacaatggcgcatacagcgggtagctacctggtgacaggatgccaatctcgaaaagtgcgtctcagttcggattgtagtctgcaactcgactacatgaaggtggaatcgctagtaatcgcgcatcagcaatggcgcggtgaatacgttcccggaccttgtacacaccgcccgtcaagccatggaagccggggggacctgaagatggtggccgcaaggcgctatttagggttaaactggtaactggggctaagtcgtaacaaggtagccgtaccggaaggtgcggctggaacacctcctttctggag

SEQ ID NO: 3920 - DNA, 1542 bp, Flaviflexus salsibiostraticola
  ref <308>: DATABASE ACCESSION NUMBER: NCBI ACCESSION: NZ_CP034438.1
  ref <309>: DATABASE ENTRY DATE: 2019-04-01
  ref <313>: RELEVANT RESIDUES IN SEQ ID NO: (1)..(1542)
ttttacggagagtttgatcctggctcaggacgaacgctggcggcgtgcttaacacatgcaagtcgaacgatgaagtctccagcttgctgggggtggattagtggcgaacgggtgagtaacacgtgagtaacctgcccctttcttcgggataagcttgggaaactgggtctaataccggatattcagcggctgccgcatggtggttgttggaaagatttattgggaggggatgggctcgcggcctatcagcttgttggtggggtgatggcctaccaaggcgtcgacgggtagccggcctgagagggtgaccggccacactgggactgagatacggcccagactcctacgggaggcagcagtggggaatattgcacaatgagcgaaagcttgatgcagcgacgccgcgtgagggatgacggctttcgggttgtaaacctctttcggcagggaacaagtccaggttttggcctggttgagggtacctgcataagaagcgccggctaactacgtgccagcagccgcggtaatacgtagggcgcgagcgttgtccggaattattgggcgtaaagagctcgtaggcggcttgtcgcgtctgctgtgaaaacgcggggcttaactccgcgcttgcagtgggtacgggcaggcttgagtgtagtaggggagactggaattcctggtgtagcggtggaatgcgcagatatcaggaggaacaccgatggcgaaggcaggtctctgggctataactgacgctgaggagcgaaagcatggggagcgaacaggattagataccctggtagtccatgccgtaaacgttgggcactaggtgtgggggtctttgacttctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacactgcgatgttccagagatggggcagccttcggggtggtgtacaggtggtgcatggttgtcgtcagctcgtgtcgtgagatgttgggttaagtcccgcaacgagcgcaacccttgtctcgtgttgccagcacatgatggtggggactcacgagagactgccggggttaactcggaggaaggtggggatgacgtcaaatcatcatgccccttatgtcttgggcttcacgcatgctacaatggccggtacagagggttgcgatgtcgtaaggctgagcgaatcccttaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagttggcaacacccgaagcccgtggcctaacccttgtggggggagcggtcgaaggtggggttggcgattgggacgaagtcgtaacaaggtagccgtaccggaaggtgcggctggatcacctcctttctagggag

SEQ ID NO: 3921 - DNA, 1541 bp, Flaviflexus sp. H23T48
  ref <308>: DATABASE ACCESSION NUMBER: NCBI ACCESSION: NZ_CP034593.1
  ref <309>: DATABASE ENTRY DATE: 2019-04-01
  ref <313>: RELEVANT RESIDUES IN SEQ ID NO: (1)..(1541)
ttttgcggagagtttgatcctggctcaggacgaacgctggcggcgtgcttaacacatgcaagtcgaacgatgaagctggcagcttgctgttggtggattagtggcgaacgggtgagtaacacgtgagtaacctgcccccttcttcgggataagcttgggaaactgggtctaataccggatattctgcttccgccgcatggtggttgtgggaaagatttttttggtgggggatgggctcgcggcctatcagcttgttggtggggtagtggcctaccaaggcgtcgacgggtagccggcctgagagggtgaccggccacactgggactgagatacggcccagactcctacgggaggcagcagtggggaatattgcacaatgggcgcaagcttgatgcagcgacgccgcgtgagggatgacggctttcgggttgtaaacctctttcgatggggaacaaggccatatttttgtgtggttgagggtacctgtataagaagcgccggctaactacgtgccagcagccgcggtaatacgtagggcgcgagcgttgtccggaattattgggcgtaaagagctcgtaggcggcttgtcgcgtctgctgtgaaaacgcggggcttaactccgcgcttgcagtgggtacgggcaggcttgagtgtagtaggggagactggaattcctggtgtagcggtggaatgcgcagatatcaggaggaacaccgatggcgaaggcaggtctctgggctattactgacgctgaggagcgaaagcatggggagcgaacaggattagataccctggtagtccatgccgtaaacgttgggcactaggtgtggggcctttggttctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacactgcgatgttccagagatggggcagccttcggggtggtgtacaggtggtgcatggttgtcgtcagctcgtgtcgtgagatgttgggttaagtcccgcaacgagcgcaacccttgtctcgtgttgccagcatgttgtggtggggactcacgagagactgccggggttaactcggaggaaggtggggacgacgtcaaatcatcatgccccttatgtcttgggcttcacgcatgctacaatggccggtacagagggttgcgatgtcgtaaggcggagcgaatcccttaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagttggcaacacccgaagcccgtggcctaacctttttggggggagcggtcgaaggtggggctggcgattgggacgaagtcgtaacaaggtagccgtaccggaaggtgcggctggatcacctcctttctagggag

SEQ ID NO: 3922 - DNA, 1539 bp, Flavihumibacter petaseus
  ref <308>: DATABASE ACCESSION NUMBER: NCBI ACCESSION: NZ_BBWV01000016.1
  ref <309>: DATABASE ENTRY DATE: 2019-04-01
  ref <313>: RELEVANT RESIDUES IN SEQ ID NO: (1)..(1539)
ttacaatggagagtttgatcctggctcaggatgaacgctagcggcaggcctaatacatgcaagtcgaggggcagcgcagtgtagcaatacatgggcggcgaccggcaaacgggtgcggaacacgtacagaaccttcctcagagcgggggatagcccagagaaatttggattaataccccataggatagtggagtggcatcactcagctattaaagatttatcactttgagatggctgtgcgtctgattaggtagttggtgaggtaacggctcaccaagccaacgatcagtaactggtgtgagagcacgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatctgggacgaaaaagggtctttctagatcaactgacggtaccagatgaataagcaccggctaactccgtgccagcagccgcggtaatacggagggtgcaagcgttatccggattcactgggtttaaagggtgcgtaggcgggtgtgtaagtccgtggtgaaatctctgagcttaactcggaaactgccatgggtactgcatatcttgaatgttgtggaggtgagcggaatatgtcatgtagcggtgaaatgcttagatatgacatagaacaccgattgcgaaggcagctcactacacaaatattgacgctgaggcacgaaagcgtggggatcaaacaggattagataccctggtagtccacgccctaaacgatggatactcgacatacgcgatacacagtgtgtgtctgagcgaaagcattaagtatcccacctgggaagtacgaccgcaaggttgaaactcaaaggaattgacgggggtccgcacaagcggtggagcatgtggtttaattcgatgatacgcgaggaaccttacctgggctagaatgctgggggaccgtgggtgaaagctcactttatagcaatataccgccagtaaggtgctgcatggctgtcgtcagctcgtgccgtgaggtgttgggttaagtcccgcaacgagcgcaacccctatcagtagttgccaacaggttaagctgggaactctactgaaactgccgtcgtaagacgcgaggaaggaggggatgatgtcaagtcatcatggcctttatgcccagggctacacacgtgctacaatggggcgtacaaagggctgccacttagtgataaggagcgaatcccaaaaaacgcctctcagttcgaatcggagtctgcaactcgactccgtgaagctggaatcgctagtaatcgtatatcagcaatgatacggtgaatacgttcccggaccttgtacacaccgcccgtcaagccatggaagctgggtgtacctaaagtcgataaccgcaaggagtcgcctagggtaaaactagtaactggggctaagtcgtaacaaggtagccgtatcggaaggtgcggctggaatacctcctttttagagct

SEQ ID NO: 3923 - DNA, 1539 bp, Flavihumibacter solisilvae
  ref <308>: DATABASE ACCESSION NUMBER: NCBI ACCESSION: NZ_JSVC01000053.1
  ref <309>: DATABASE ENTRY DATE: 2019-04-01
  ref <313>: RELEVANT RESIDUES IN SEQ ID NO: (1)..(1539)
ttacaatggagagtttgatcctggctcaggatgaacgctagcggcaggcctaatacatgcaagtcgaggggcagcgcagtgtagcaatacatgggcggcgaccggcaaacgggtgcggaacacgtacagaaccttccttcgagcggggaatagcccagagaaatttggattaataccccatagtatattggagtggcatcactttgatattaaagatttatcacttgaagatggctgtgcgtctgattaggtagttggtggggtaacggcccaccaagccaacgatcagtaactggtgtgagagcacgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatctgggacgaaaaaagggaattctttctcgtctgacggtaccagatgaataagcaccggctaactccgtgccagcagccgcggtaatacggagggtgcaagcgttatccggattcactgggtttaaagggtgcgtaggcgggtgtgtaagtccgtggtgaaatctccgagcttaactcggaaactgccatgggtactgcatgtcttgaatgttgtggaggtgagcggaatatgtcatgtagcggtgaaatgcttagatatgacatagaacaccaattgcgaaggcagctcactacacaaatattgacgctgaggcacgaaagcgtggggatcaaacaggattagataccctggtagtccacgccctaaacgatgattactcgacatacgcgatacactgtgtgtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgctggtggaccgtgggtgaaagctcactttgtagcaatacaccgccagtaaggtgctgcatggctgtcgtcagctcgtgccgtgaggtgttgggttaagtcccgcaacgagcgcaacccctatctttagttgccaacaggttaagctgggaactctaaagaaactgccgtcgtaagacgcgaggaaggaggggatgatgtcaagtcatcatggcctttatgcccagggctacacacgtgctacaatggggcgtacaaagggctgccacttagtgataaggagcgaatcccaaaaaacgcctctcagttcgaatcggagtctgcaactcgactccgtgaagctggaatcgctagtaatcgtatatcagcaatgatacggtgaatacgttcccggaccttgtacacaccgcccgtcaagccatggaagccgggtgtacctaaagtcgataaccgcaaggagtcgcctagggtaaaactggtaactggggctaagtcgtaacaaggtagccgtatcggaaggtgcggctggaatacctcctttttagagct

SEQ ID NO: 3924 - DNA, 1466 bp, Flavimaricola marinus
  ref <308>: DATABASE ACCESSION NUMBER: NCBI ACCESSION: NZ_FXZK01000033.1
  ref <309>: DATABASE ENTRY DATE: 2019-04-01
  ref <313>: RELEVANT RESIDUES IN SEQ ID NO: (1)..(1466)
tcaacttgagagtttgatcctggctcagaacgaacgctggcggcaggcctaacacatgcaagtcgagcgcaccttcgggtgagcggcggacgggttagtaacgcgtgggaatatgcccatccctacggaatagcctcgggaaactgagagtaataccgtatacgcccttcgggggaaagatttatcggggatggattagcccgcgtctgattagatagttggtggggtaatggcctaccaagtctacgatcagtagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggattagtaagttagaggtgaaatcccagggctcaaccttggaactgcctttaatactgctagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgttggggggcttgcccttcagtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctctgaccggccaggagactggcttttctcgtaagagacagagtgacaggtgctgcatggctgtcgtcagctcgtgtcgtgagatgttcggttaagtccggcaacgagcgcaacccacatctttagttgccagcattcagttgggcactctaaagaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaaggtggtgcgccaaccagcaatggaggcagccaaccacggtaggctcagcgactggggtgaagtcgtaacaaggtagccgtaggggaacctgcggctggatcacctcctttctaa

SEQ ID NO: 3925 - DNA, 1533 bp, Flavisolibacter sp. X7X
  ref <308>: DATABASE ACCESSION NUMBER: NCBI ACCESSION: NZ_RBCI01000027.1
  ref <309>: DATABASE ENTRY DATE: 2019-04-01
  ref <313>: RELEVANT RESIDUES IN SEQ ID NO: (1)..(1533)
tggagagtttgatcctggctcaggatgaacgctagcggcaggcttaatacatgcaagtcgaggggcagcgcagtgtagcaatacatgggcggcgaccggcaaacgggtgcggaacacgtacgcaacctacccaaaactgggggatagcccaccgaaaggtggattaatacctcgtaacctcgtgaagcggcatcgctttatgagtatagctccggcggttttggatgggcgtgcgcctgattaggtagttggcggggtaacggcccaccaagcctgcgatcagtaactggtgtgagagcacgaccagtcacacgggcactgagacacgggcccgactcctacgggaggcagcagtaaggaatattggtcaatggacgcaagtctgaaccagccatgccgcgtgaaggatgaaggtcctctggattgtaaacttcttttatctgggacgaaaccctcgttttctaacgggattgacggtaccagaggaataagcaccggctaactccgtgccagcagccgcggtaatacggagggtgcaagcgttatccggattcactgggtttaaagggtgcgtaggagggcagggaagtcagtggtgaaatctccgggcttaactcggaaactgccgttgatactctctgtcttgaatcccgtggaggtgagcggaatatgtcatgtagcggtgaaatgcttagatatgacatagaacaccaattgcgaaggcagctcgctacacgaagattgactctgaggcacgaaagcgtggggatcaaacaggattagataccctggtagtccacgccctaaacgatggatactcgacatacgcgatacactgtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgctggttgaccgtgggtgaaagctcactttgtagcaatacacaaccagtaaggtgctgcatggctgtcgtcagctcgtgccgtgaggtgttgggttaagtcccgcaacgagcgcaacccccatcagtagttgccatcaggtaacgctgggaactctactgaaactgccgtcgtaagacgcgaggaaggaggggatgatgtcaagtcatcatggcctttatgcccagggctacacacgtgctacaatggggcgtacaaagggctgccacttagcgataaggagccaatcccaaaaaacgcctctcagttcagatcgcagtctgcaactcgactgcgtgaagctggaatcgctagtaatcgtatatcagcaatgatacggtgaatacgttcccggaccttgcacacaccgcccgtcaagccatggaagctgggtgtacctaaagtcggtaaccgcaaggagccgcctagggtaaaactagtaactggggctaagtcgtaacaaggtagccgtatcggaaggtgcggctggaatacctcctttttagagct

SEQ ID NO: 3926 - DNA, 1520 bp, Flavivirga eckloniae
  ref <308>: DATABASE ACCESSION NUMBER: NCBI ACCESSION: NZ_CP025791.1
  ref <309>: DATABASE ENTRY DATE: 2019-04-01
  ref <313>: RELEVANT RESIDUES IN SEQ ID NO: (1)..(1520)
acgatgaagagtttgatcctggctcaggatgaacgctagcggcaggcctaacacatgcaagtcgaggggtaacattggtgcttgcaccagatgacgaccggcgcacgggtgcgtaacgcgtatacaatctgccccgtactgggggatagcctttagaaatgaagattaataccccatagtactgcagccccgcctggggccgcagttaaaggttacggtacgggatgagtatgcgtcctattagctagatggtgtggtaacggcacaccatggcaacgataggtaggggccctgagagggggatcccccacactggtactgagacacggaccagactcctacgggaggcagcagtgaggaatattggacaatggaggcaactctgatccagccatgccgcgtgcaggaagactgccctatgggttgtaaactgcttttgtacaggaagaaacaccccgacgtgtcggggcttgacggtactgtaagaataaggatcggctaactccgtgccagcagccgcggtaatacggaggatccaagcgttatccggaatcattgggtttaaagggtccgtaggtggatgattaagtcagaggtgaaatcctgcagctcaactgtagaattgcctttgatactggtcgtcttgagttactgtgaagtagttagaatatgtagtgtagcggtgaaatgcatagatattacatagaataccaattgcgaaggcagattactaacagtacactgacactgatggacgaaagcgtggggagcgaacaggattagataccctggtagtccacgccgtaaacgatggatactagctgttcggatttatctgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtagagtgacaggtctagagatagacttttcttcggacactttacaaggtgctgcatggttgtcgtcagctcgtgccgtgaggtgtcaggttaagtcctataacgagcgcaacccctgttgttagttgccagcatgtaaagatgggaactctaacaagactgccggtgcaaaccgtgaggaaggtggggatgacgtcaaatcatcacggcccttacgtcctgggctacacacgtgctacaatggtagggacagagagcagccacttcgcgagaaggagcgaatctacaaaccctatcacagttcggatcggagtctgcaactcgactccgtgaagctggaatcgctagtaatcgcatatcagccatgatgcggtgaatacgttcccgggccttgtacacaccgcccgtcaagccatggaagctgggagtgcctgaagtccgtcaccgcaaggagcggcctagggtaaaatcggtaactagggctaagtcgtaacaaggtagccgtaccggaaggtgcggctggaacacctcctttct

SEQ ID NO: 3927 - DNA, 1544 bp, Flavobacteriaceae bacterium Hp12
  ref <308>: DATABASE ACCESSION NUMBER: NCBI ACCESSION: NZ_QDDL01000018.1
  ref <309>: DATABASE ENTRY DATE: 2019-04-01
  ref <313>: RELEVANT RESIDUES IN SEQ ID NO: (1)..(1544)
taaattgaagagtttgatcatggctcagattgaacgctggcggcatgcctaacacatgcaagtcgagcggaaacgaagatagcttgctatcaggcgtcgagcggcggacgggtgagtaacgcgtgggaatctacctagtagtgggggacaacattcggaaacggatgctaataccgcatacgcctttagggggaaagcaggggatcttcggaccttgtgctattagatgagcccgcgtcggattagctagttggtgaggtaatggctcaccaaggcaacgatccgtagctggtctgagaggatgatcagccacatcgggactgagacacggcccgaactcctacgggaggcagcagtggggaatattggacaatgggggcaaccctgatccagcaatgccgcgtgtgtgaagaaggcctatgggttgtaaagcactttcagcgaggaggaacgattattgtttaatatgcaatagtcttgacgttactcgcagaagaagcaccggctaactctgtgccagcagccgcggtaatacagagggtgcaagcgttaatcggaattactgggcgtaaagcgcgcgtaggcggcttgccaagtcagatgtgaaagccccgggctcaacctgggaactgcatctgatactggttcgctagagtgcagcagaggagtgtggaatttcaggtgtagcggtgaaatgcgtagatatctgaaggaacaccagtggcgaaggcgacactctgggctgacactgacgctgaggtgcgaaagcgtggggagcaaacaggattagataccctggtagtccacgccgtaaacgatgtcaactagccgtcggatccgtctgggatttggtggcgcagctaacgcgataagttgaccgcctggggagtacggccgcaaggttaaaactcaaatgaattgacgggggcccgcacaagcggtggagcatgtggtttaattcgatgcaacgcgaagaaccttaccaggccttgacatcctgtgaacttactagagatagtttggtgccttcgggaacacagtgacaggtgctgcatggctgtcgtcagctcgtgtcgtgagatgttgggttaagtcccgtaacgagcgcaacccttgtccttagttgctaacagttcggctgagaactctagggagactgccggtgacaaaccggaggaaggtggggacgacgtcaagtcatcatggcccttatggcctgggctacacacgtgctacaatggcgcatacagagggctgccaactagcaatagtgcgcgaatcccttaaagtgcgtcgtagtccggattggagtctgcaactcgactccatgaagtcggaatcgctagtaatcgcgaatcagaatgtcgcggtgaatacgttcccgggccttgtacacaccgcccgtcacaccatgggagtgggttgctccagaagtggctagtctaactgcttgcagaggacggtcaccacggagtggttcatgactggggtgaagtcgtaacaaggtagccctaggggaacctggggctggatcacctccttat

SEQ ID NO: 3928 - DNA, 1533 bp, Flavobacteriaceae bacterium MAR 2009 75
  ref <308>: DATABASE ACCESSION NUMBER: NCBI ACCESSION: NZ_PHTZ01000001.1
  ref <309>: DATABASE ENTRY DATE: 2019-04-01
  ref <313>: RELEVANT RESIDUES IN SEQ ID NO: (1)..(1533)
caacgatgaagagtttgatcctggctcaggatgaacgctagcggcaggcctaacacatgcaagtcgaggggcagcgggagaaagcttgctttcttgccggcgaccggcgcacgggtgcgcaacgcgtatggaacctgcccttgtccggggaatagcccagagaaatttggattaatgccccatagtacccctttgttgcataactggggggttaaagatttatcggacagggatggccatgcgtaccattagttagttggcggggtaacggcccaccaaggcatcgatggttaggggccctgagagggggatcccccacactggtactgagacacggaccagactcctacgggaggcagcagtgaggaatattggacaatggagggaactctgatccagccatgccgcgtgcgggaagaaggccctatgggtcgtaaaccgcttttatacgggaagaaaaagggctacgtgtagcctgttgacggtaccgtaagaataaggaccggctaactccgtgccagcagccgcggtaatacggagggtccgagcgttatccggaatcattgggtttaaagggtccgtaggcgggccgttaagtcaggggtgaaagtctgcggctcaaccgtagaactgcccttgatactggcggtcttgagtcatattggagtgggcggaatatgtagtgtagcggtgaaatgcatagatattacatagaacaccgatcgcgaaggcagctcactaagtatgtactgacgctgatggacgaaagcgtggggagcgaacaggattagataccctggtagtccacgccgtaaacgatggatactagctgtccgggtccttgagacctgggcggccaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgcattttgacagggtcagagatgacctttccttcgggcaatttgcaaggtgctgcatggttgtcgtcagctcgtgccgtgaggtgtcaggttaagtcctataacgagcgcaacccctaccgttagttgccagcatgtcatgatggggactctaacgggactgccggtgcaaaccgtgaggaaggtggggacgacgtcaaatcatcacggcccttacgtcctgggccacacacgtgctacaatggcaggtacagcgggaagccactgcgcaagcaggagcggatccacaaaacctgtcacagttcggatcggggtctgcaacccgaccccgtgaagctggaatcgctagtaatcggatatcagccatgatccggtgaatacgttcccgggccttgtacacaccgcccgtcaagccatggaagccgggagtgcctgaagtccgtcaccgcaaggagcggcctagggcaagatcggtaactagggctaagtcgtaacaaggtagccgtaccggaaggtgcggctggaacacctcctttct

SEQ ID NO: 3929 - DNA, 1437 bp, Flavobacterium aquicola
  ref <308>: DATABASE ACCESSION NUMBER: NCBI ACCESSION: NZ_QUNI01000030.1
  ref <309>: DATABASE ENTRY DATE: 2019-04-01
  ref <313>: RELEVANT RESIDUES IN SEQ ID NO: (1)..(1437)
ggaattagagaccggcgcacgggtgcgtaacgcgtatgcaatctaccttttacagagggatagcccagagaaatttggattaatacctcatagtataacgactcggcatcgagatgttattaaagtcacaacggtaaaagatgagcatgcgtcccattagctagttggtaaggtaacggcttaccaaggcgacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttgtacaggaagaaacaacgctacgtgtagcgtcttgacggtactgtaagaataaggatcggctaactccgtgccagcagccgcggtaatacggaggatccaagcgttatccggaatcattgggtttaaagggtccgtaggcggtttggtaagtcagtggtgaaagcccatcgctcaacggtggaacggccattgatactgccagacttgaattactgggaagtaactagaatatgtagtgtagcggtgaaatgcttagagattacatggaataccaattgcgaaggcaggttactaccagtggattgacgctgatggacgaaagcgtgggtagcgaacaggattagataccctggtagtccacgccgtaaacgatggatactagctgttgggggcaacttcagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggcttaaatgtagtctgaccgatttggaaacagatctttcgcaagacagattacaaggtgctgcatggttgtcgtcagctcgtgccgtgaggtgtcaggttaagtcctataacgagcgcaacccctgttgttagttgccagcgagtcatgtcgggaactctaacgagactgccagtgcaaactgtgaggaaggtggggatgacgtcaaatcatcacggcccttacgccttgggctacacacgtgctacaatggccggtacagagagcagccacctcgcgagggggagcgaatctataaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgtaccggaaggtgcggctggaacacctcctttcta

SEQ ID NO: 3930 - DNA, 1518 bp, Flavobacterium cupreum
  ref <308>: DATABASE ACCESSION NUMBER: NCBI ACCESSION: NZ_QWDM01000035.1
  ref <309>: DATABASE ENTRY DATE: 2019-04-01
  ref <313>: RELEVANT RESIDUES IN SEQ ID NO: (1)..(1518)
tacgatgaagagtttgatcctggctcaggatgaacgctagcggcaggcttaacacatgcaagtcgaggggtataagtcttcggatttagagaccggcgcacgggtgcgtaacgcgtatgcaatctaccttttacagagggatagcccagagaaatttggattaatacctcatagtattatagaatggcatcattttataattaaagtcacaacggtaaaagatgagcatgcgtcccattagctagttggtaaggtaacggcttaccaaggctacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttgtacaggaagaaacactggttcgtgaaccagcttgacggtactgtaagaataaggatcggctaactccgtgccagcagccgcggtaatacggaggatccaagcgttatccggaatcattgggtttaaagggtccgtaggcggtttaataagtcagtggtgaaagcccatcgctcaacggtggaacggccattgatactgttagacttgaattattaggaagtaactagaatatgtagtgtagcggtgaaatgcttagagattacatggaataccaattgcgaaggcaggttactactaattgattgacgctgatggacgaaagcgtgggtagcgaacaggattagataccctggtagtccacgccgtaaacgatggatactagctgttggaagcaatttcagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggcttaaatgtagattgaccggtttggaaacagatctttcgcaagacaatttacaaggtgctgcatggttgtcgtcagctcgtgccgtgaggtgtcaggttaagtcctataacgagcgcaacccctgttgttagttgccagcgagtcaagtcgggaactctaacaagactgccagtgcaaactgtgaggaaggtggggatgacgtcaaatcatcacggcccttacgccttgggctacacacgtgctacaatggccggtacagagagcagccactgggcgaccaggagcgaatctataaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgtaccggaaggtgcggctggaacacctcctttcta

SEQ ID NO: 3931 - DNA, 1318 bp, Flavobacterium gillisiae
  ref <308>: DATABASE ACCESSION NUMBER: NCBI ACCESSION: NZ_FNRD01000029.1
  ref <309>: DATABASE ENTRY DATE: 2019-04-01
  ref <313>: RELEVANT RESIDUES IN SEQ ID NO: (1)..(1318)
ttaaagatttatcggtgaaagatgagcatgcgtcccattagctagttggtatggtaacggcataccaaggctacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttatacaggaagaaacacctctacgtgtagagacttgacggtactgtaagaataaggatcggctaactccgtgccagcagccgcggtaatacggaggatccaagcgttatccggaatcattgggtttaaagggtccgtaggcggtcaggtaagtcagtggtgaaagcccatcgctcaacggtggaacggccattgatactgcttgacttgaattattaggaagtaactagaatatgtagtgtagcggtgaaatgcttagagattacatggaataccaattgcgaaggcaggttactactaatatattgacgctgatggacgaaagcgtgggtagcgaacaggattagataccctggtagtccacgccgtaaacgatggatactagctgttgggagcaatctcagtggctaagcgaaagtgataagtatcccacctggggagtacgaacgcaagtttgaaactcaaaggaattgacgggggcccgcacaagcggtggagcatgtggtttaattcgatgatacgcgaggaaccttaccaaggcttaaatgtagattgaccgttttggaaacagaactttcgcaagacaatttacaaggtgctgcatggttgtcgtcagctcgtgccgtgaggtgtcaggttaagtcctataacgagcgcaacccctgttgttagttgccagcgagtcatgtcgggaactctaacgagactgccagtgcaaactgtgaggaaggtggggatgacgtcaaatcatcacggcccttacgccttgggctacacacgtgctacaatggccggtacagagagcagccactgggcgaccaggagcgaatctacaaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgtaccggaaggtgcggctggaacacctcctttcta

SEQ ID NO: 3932 - DNA, 1518 bp, Flavobacterium sp. 103
  ref <308>: DATABASE ACCESSION NUMBER: NCBI ACCESSION: NZ_QENX01000001.1
  ref <309>: DATABASE ENTRY DATE: 2019-04-01
  ref <313>: RELEVANT RESIDUES IN SEQ ID NO: (1)..(1518)
tacgatgaagagtttgatcctggctcaggatgaacgctagcggcaggcttaacacatgcaagtcgaggggtattggttttcggaccaagagaccggcgcacgggtgcgtaacgcgtatgcaatctaccttttacagagggatagcccagagaaatttggattaatacctcatagtatagtacaatcgcatgattgaactattaaagtcacaacggtaaaagatgagcatgcgtcccattagctagttggtaaggtaacggcttaccaaggctacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttgcacaggaagaaacaacgctacgtgtagcgtcttgacggtactgtgagaataaggatcggctaactccgtgccagcagccgcggtaatacggaggatccaagcgttatccggaatcattgggtttaaagggtccgtaggcggtttggtaagtcagtggtgaaagcccatcgctcaacggtggaacggccattgatactgccagacttgaattattaggaagtaactagaatatgtagtgtagcggtgaaatgcttagagattacatggaataccaattgcgaaggcaggttactactaatggattgacgctgatggacgaaagcgtgggtagcgaacaggattagataccctggtagtccacgccgtaaacgatggatactagctgttgggagcgatctcagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggcttaaatgtagattgaccggtttggaaacagacttttcgcaagacaatttacaaggtgctgcatggttgtcgtcagctcgtgccgtgaggtgtcaggttaagtcctataacgagcgcaacccctgttgttagttgccagcgagtcatgtcgggaactctaacgagactgccagtgcaaactgtgaggaaggtggggatgacgtcaaatcatcacggcccttacgccttgggctacacacgtgctacaatggccggtacagagagcagccactgggtgaccaggagcgaatctacaaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgtaccggaaggtgcggctggaacacctcctttcta

SEQ ID NO: 3933 - DNA, 1518 bp, Flavobacterium sp. 123
  ref <308>: DATABASE ACCESSION NUMBER: NCBI ACCESSION: NZ_RBXD01000001.1
  ref <309>: DATABASE ENTRY DATE: 2019-04-01
  ref <313>: RELEVANT RESIDUES IN SEQ ID NO: (1)..(1518)
tacgatgaagagtttgatcctggctcaggatgaacgctagcggcaggcttaacacatgcaagtcgaggggtatagttcttcggaactagagaccggcgcacgggtgcgtaacgcgtatgcaatctacctttcacaaagggatagcccagagaaatttggattaataccttatagtatatatgaatggcatcatttatatattaaagatttatcggtgaaagatgagcatgcgtcccattagcttgttggtaaggtaacggcttaccaaggctacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttgtacaggaagaaacagttctacgtgtagaaccttgacggtactgtaagaataaggatcggctaactccgtgccagcagccgcggtaatacggaggatccaagcgttatccggaatcattgggtttaaagggtccgtaggcggttagataagtcagtggtgaaagcccatcgctcaacggtggaacggccattgatactgtctgacttgaattattaggaagtaactagaatatgtagtgtagcggtgaaatgcttagagattacatggaataccaattgcgaaggcaggttactactaatggattgacgctgatggacgaaagcgtgggtagcgaacaggattagataccctggtagtccacgccgtaaacgatggatactagctgttgggcgcaagttcagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggcttaaatgtagtttgaccgttttggaaacagaactttcgcaagacaaattacaaggtgctgcatggttgtcgtcagctcgtgccgtgaggtgtcaggttaagtcctataacgagcgcaacccctgttgttagttgccagcgagtcatgtcgggaactctaacgagactgccagtgcaaactgtgaggaaggtggggatgacgtcaaatcatcacggcccttacgccttgggctacacacgtgctacaatggccggtacagagagcagccactgggcgaccaggagcgaatctacaaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgtaccggaaggtgcggctggaacacctcctttcta

SEQ ID NO: 3934 - DNA, 1517 bp, Flavobacterium sp. 140616W15
  ref <308>: DATABASE ACCESSION NUMBER: NCBI ACCESSION: NZ_CP033068.1
  ref <309>: DATABASE ENTRY DATE: 2019-04-01
  ref <313>: RELEVANT RESIDUES IN SEQ ID NO: (1)..(1517)
tacgatgaagagtttgatcctggctcaggatgaacgctagcggcaggcttaacacatgcaagtcgaggggtatgcttcttcggaagcagagaccggcgcacgggtgcgtaacgcgtatgcaatctaccttttacagagggatagcccagagaaatttggattaatacctcatagtattattaaatggcatcattttataattaaagtcacaacggtaaaagatgagcatgcgtcccattagctagttggtaaggtaacggcttaccaaggctacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttatacaggaagaaaccctggttcgtgaaccagcttgacggtactgtaagaataaggatcggctaactccgtgccagcagccgcggtaatacggaggatccaagcgttatccggaatcattgggtttaaagggtccgtaggcggtttaataagtcagtggtgaaagcccatcgctcaacggtggaacggccattgatactgttaaacttgaattattaggaagtaactagaatatgtagtgtagcggtgaaatgcttagagattacatggaataccaattgcgaaggcaggttactactaatatattgacgctgatggacgaaagcgtgggtagcgaacaggattagataccctggtagtccacgccgtaaacgatggatactagctgttgggagcaatctcagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggcttaaatgtagtttgaccgatttggaaacagatttttcgcaagacaaattacaaggtgctgcatggttgtcgtcagctcgtgccgtgaggtgtcaggttaagtcctataacgagcgcaacccctgttgttagttgccagcgagtcatgtcgggaactctaacaagactgccagtgcaaactgtgaggaaggtggggatgacgtcaaatcatcacggcccttacgccttgggctacacacgtgctacaatggccggtacagagagcagccactgggcgaccaggagcgaatctataaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgtaccggaaggtgcggctggaacacctcctttct

SEQ ID NO: 3935 - DNA, 1319 bp, Flavobacterium sp. A45
  ref <308>: DATABASE ACCESSION NUMBER: NCBI ACCESSION: NZ_MUNX01000026.1
  ref <309>: DATABASE ENTRY DATE: 2019-04-01
  ref <313>: RELEVANT RESIDUES IN SEQ ID NO: (1)..(1319)
attaaagtcacaacggtaaaagatgagcatgcgtcccattagctagttggtaaggtaacggcttaccaaggctacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttgcacaggaagaaacaacgctacgtgtagcgtcttgacggtactgtgagaataaggatcggctaactccgtgccagcagccgcggtaatacggaggatccaagcgttatccggaatcattgggtttaaagggtccgtaggcggtttagtaagtcagtggtgaaagcccatcgctcaacggtggaacggccattgatactgctagacttgaattattaggaagtaactagaatatgtagtgtagcggtgaaatgcttagagattacatggaataccaattgcgaaggcaggttactactaatggattgacgctgatggacgaaagcgtgggtagcgaacaggattagataccctggtagtccacgccgtaaacgatggatactagctgttgggagcgatctcagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggcttaaatgtagattgaccgttttggaaacagaactttcgcaagacaatttacaaggtgctgcatggttgtcgtcagctcgtgccgtgaggtgtcaggttaagtcctataacgagcgcaacccctgttgttagttgccagcgagtcatgtcgggaactctaacgagactgccagtgcaaactgtgaggaaggtggggatgacgtcaaatcatcacggcccttacgccttgggctacacacgtgctacaatggccggtacagagagcagccactgggtgaccaggagcgaatctacaaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgtaccggaaggtgcggctggaacacctcctttcta

SEQ ID NO: 3936 - DNA, 1244 bp, Flavobacterium sp. BBQ-12
  ref <308>: DATABASE ACCESSION NUMBER: NCBI ACCESSION: NZ_SACJ01000025.1
  ref <309>: DATABASE ENTRY DATE: 2019-04-01
  ref <313>: RELEVANT RESIDUES IN SEQ ID NO: (1)..(1244)
tacgatgaagagtttgatcctggctcaggatgaacgctagcggcaggcttaacacatgcaagtcgaggggtattggttttcggaccaagagaccggcgcacgggtgcgtaacgcgtatgcaatctacctttcacagagggatagcccagagaaatttggattaatacctcatagtattatagagtggcatcattttataattaaagttccaacggtgaaagatgagcatgcgtcccattagctagatggtaaggtaacggcttaccatggcaacgatgggtaggggtcctgagagggagatcccccacactggtactgagacacggaccagactcctacgggaggcagcagtgaggaatattggtcaatggacgcaagtctgaaccagccatgccgcgtgcaggatgacggtcctatggattgtaaactgcttttgtacgagaagaaacaacattacgtgtaatgtcttgacggtatcgtaagaataaggatcggctaactccgtgccagcagccgcggtaatacggaggatccaagcgttatccggaatcattgggtttaaagggtccgtaggcggtttagtaagtcagtggtgaaagcccatcgctcaacggtggaacggccattgatactgctagacttgaattattaggaagtaactagaatatgtagtgtagcggtgaaatgcttagagattacatggaataccaattgcgaaggcaggttactactaatttattgacgctgatggacgaaagcgtgggtagcgaacaggattagataccctggtagtccacgccgtaaacgatggatactagctgttgggggcaacttcagtggctaagcgaaagtgataagtatcccacctggggagtacgggcgcaagcctgaaactcaaaggaattgacgggggcccgcacaagcggtggagcatgtggtttaattcgatgatacgcgaggaaccttaccaaggcttaaatgtagattgaccggtttggaaacagacttttcgcaagacaatttacaaggtgctgcatggttgtcgtcagctcgtgccgtgaggtgtcaggttaagtcctataacgagcgcaacccctgttgttagttgccagcgagtcatgtcgggaactctaacgagactgccagtgcaaactgtgaggaaggtggggatgacgtcaaatcatcacggcccttacgccttgggctacacacgtgctacaatggccggtacagagagcagccac

SEQ ID NO: 3937 - DNA, 1518 bp, Flavobacterium sp. IMCC34762
  ref <308>: DATABASE ACCESSION NUMBER: NCBI ACCESSION: NZ_QKXH01000001.1
  ref <309>: DATABASE ENTRY DATE: 2019-04-01
  ref <313>: RELEVANT RESIDUES IN SEQ ID NO: (1)..(1518)
tacgatgaagagtttgatcctggctcaggatgaacgctagcggcaggcttaacacatgcaagtcgaggggtattgttcttcggaatgagagaccggcgcacgggtgcgtaacgcgtatgcaatctaccttttacagagggatagcccagagaaatttggattaatacctcatagtatggcgacatcgcatgatgatgccattaaagtcacaacggtaaaagatgagcatgcgtcccattagctagttggtaaggtaacggcttaccaaggcaacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttgtacgagaagaaacactccttcgtgaaggagcttgacggtatcgtaagaataaggatcggctaactccgtgccagcagccgcggtaatacggaggatccaagcgttatccggaatcattgggtttaaagggtccgtaggcggtttagtaagtcagtggtgaaagcccatcgctcaacggtggaacggccattgatactgctagacttgaattattaggaagtaactagaatatgtagtgtagcggtgaaatgcttagagattacatggaataccaattgcgaaggcaggttactactaatggattgacgctgatggacgaaagcgtgggtagcgaacaggattagataccctggtagtccacgccgtaaacgatggatactagctgttgggagcgatctcagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggcttaaatgtagattgaccggtttggaaacagacttttcgcaagacaatttacaaggtgctgcatggttgtcgtcagctcgtgccgtgaggtgtcaggttaagtcctataacgagcgcaacccctgttgttagttgccagcgagtcatgtcgggaactctaacgagactgccagtgcaaactgtgaggaaggtggggatgacgtcaaatcatcacggcccttacgccttgggctacacacgtgctacaatggccggtacagagagcagccactgggtgaccaggagcgaatctacaaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgtaccggaaggtgcggctggaacacctcctttcta

SEQ ID NO: 3938 - DNA, 1538 bp, Flavobacterium sp. LB2P30; identical to SEQ ID NO: 1504
  ref <308>: DATABASE ACCESSION NUMBER: NCBI ACCESSION: NZ_QCZH01000046.1
  ref <309>: DATABASE ENTRY DATE: 2019-04-01
  ref <313>: RELEVANT RESIDUES IN SEQ ID NO: (1)..(1538)

SEQ ID NO: 3939 - DNA, 1323 bp, Flavobacterium sp. T13
  ref <308>: DATABASE ACCESSION NUMBER: NCBI ACCESSION: NZ_RPOC01000033.1
  ref <309>: DATABASE ENTRY DATE: 2019-04-01
  ref <313>: RELEVANT RESIDUES IN SEQ ID NO: (1)..(1323)
tataattaaagtcacaacggtgaaagatgagcatgcgtcccattagctagttggcagggtaacggcctaccaaggctacgatgggtaggggtcctgagagggagatcccccacactggtactgagacacggaccagactcctacgggaggcagcagtgaggaatattggtcaatgggcgcaagcctgaaccagccatgccgcgtgcaggatgacggtcctatggattgtaaactgcttttgtacgggaagaaacactcctacgagtaggagcctgacggtaccgtaagaataaggatcggctaactccgtgccagcagccgcggtaatacggaggatccaagcgttatccggaatcattgggtttaaagggtccgtaggcggtcctgtaagtcagtggtgaaagcccatcgctcaacgatggaacggccattgatactgcaggacttgaattatcaggaagcaactagaatatgtagtgtagcggtgaaatgcttagagattacatggaataccaattgcgaaggcaggttgctactggtggattgacgctgatggacgaaagcgtgggtagcgaacaggattagataccctggtagtccacgccgtaaacgatggatactagctgttgggggcaacttcagtggctaagcgaaagtgataagtatcccacctggggagtacgaacgcaagtttgaaactcaaaggaattgacgggggcccgcacaagcggtggagcatgtggtttaattcgatgatacgcgaggaaccttaccaaggcttaaatgcagactgaccgttttggaaacagaactttcgcaagacagtctacaaggtgctgcatggttgtcgtcagctcgtgccgtgaggtgtcaggttaagtcctataacgagcgcaacccctgttgttagttgccagcgagtcatgtcgggaactctaacaagactgccagtgcaaactgtgaggaaggtggggatgacgtcaaatcatcacggcccttacgccttgggctacacacgtgctacaatggccggtacagagagcagccactgggtgaccaggagcgaatctataaagccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgtaccggaaggtgcggctggaacacctcctttcta

SEQ ID NO: 3940 - DNA, 1321 bp, Flavobacterium sp. WG21
  ref <308>: DATABASE ACCESSION NUMBER: NCBI ACCESSION: NZ_AMYW01000070.1
  ref <309>: DATABASE ENTRY DATE: 2019-04-01
  ref <313>: RELEVANT RESIDUES IN SEQ ID NO: (1)..(1321)
ctattaaagtcacaacggtaaaagatgagcatgcgtcccattagctagttggtaaggtaacggcttaccaaggctacgatgggtaggggtcctgagagggagatcccccacactggtactgagacacggaccagactcctacgggaggcagcagtgaggaatattggacaatgggcgcaagcctgatccagccatgccgcgtgcaggatgacggtcctatggattgtaaactgcttttgtacgagaagaaacactcctacgtgtaggagcttgacggtatcgtaagaataaggatcggctaactccgtgccagcagccgcggtaatacggaggatccaagcgttatccggaatcattgggtttaaagggtccgtaggcggtttagtaagtcagtggtgaaagcccatcgctcaacggtggaacggccattgatactgctaaacttgaattattaggaagtaactagaatatgtagtgtagcggtgaaatgcttagagattacatggaataccaattgcgaaggcaggttactactaatggattgacgctgatggacgaaagcgtgggtagcgaacaggattagataccctggtagtccacgccgtaaacgatggatactagctgttggaagcaatttcagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggcttaaatgtagtttgaccgatttggaaacagatctttcgcaagacaaattacaaggtgctgcatggttgtcgtcagctcgtgccgtgaggtgtcaggttaagtcctataacgagcgcaacccctgttgttagttgccagcgagtcatgtcgggaactctaacaagactgccagtgcaaactgtgaggaaggtggggatgacgtcaaatcatcacggcccttacgccttgggctacacacgtgctacaatggccggtacagagagcagccactgggcgaccaggagcgaatctataaaaccggtcacagttcggatcggagtctgcaactcgactccgtgaagctggaatcgctagtaatcggatatcagccatgatccggtgaatacgttcccgggccttgtacacaccgcccgtcaagccatggaagctgggggtgcctgaagtcggtgaccgcaaggagctgcctagggtaaaactggtaactagggctaagtcgtaacaaggtagccgtaccggaaggtgcggctggaacacctcctttcta

SEQ ID NO: 3941 - DNA, 1539 bp, Flavonifractor plautii
  ref <308>: DATABASE ACCESSION NUMBER: NCBI ACCESSION: NZ_NHMQ01000002.1
  ref <309>: DATABASE ENTRY DATE: 2019-04-01
  ref <313>: RELEVANT RESIDUES IN SEQ ID NO: (1)..(1539)
tttattgagagtttgatcctggctcaggatgaacgctggcggcgtgcttaacacatgcaagtcgaacggggtgctcatgacggaggattcgtccaacggattgagttacctagtggcggacgggtgagtaacgcgtgaggaacctgccttggagaggggaataacactccgaaaggaatgctaataccgcatgatgcagttgggtcgcatggctctgactgccaaagatttatcgctctgagatggcctcgcgtctgattagctggtaggcggggtaacggcccacctaggcgacgatcagtagccggactgagaggttgaccggccacattgggactgagacacggcccagactcctacgggaggcagcagtggggaatattgggcaatgggcgcaagcctgacccagcaacgccgcgtgaaggaagaaggctttcgggttgtaaacttcttttgtcggggacgaaacaaatgacggtacccgacgaataagccacggctaactacgtgccagcagccgcggtaatacgtaggtggcaagcgttatccggatttactgggtgtaaagggcgtgtaggcgggattgcaagtcagatgtgaaaactgggggctcaacctccagcctgcatttgaaactgtagttcttgagtgctggagaggcaatcggaattccgtgtgtagcggtgaaatgcgtagatatacggaggaacaccagtggcgaaggcggattgctggacagtaactgacgctgaggcgcaaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcccactaacgaggcagagatgcgttaggtgcccttcggggaaagtggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggtggtaaacagagggaggcaaagccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagcctaaccgcaaggggggcgcggccgaaggtgggttcgataattggggtgaagtcgtaacaaggtagccgtatcggaaggtgcggctggatcacctcctttctaagga

SEQ ID NO: 3942 - DNA, 1508 bp, Flectobacillus major
  ref <308>: DATABASE ACCESSION NUMBER: NCBI ACCESSION: NZ_KE386491.1
  ref <309>: DATABASE ENTRY DATE: 2019-04-01
  ref <313>: RELEVANT RESIDUES IN SEQ ID NO: (1)..(1508)
tttacaatggagagtttgatcctggctcaggatgaacgctagcggcaggcctaatacatgcaagtcgaacggtgtagaaatacacagtggcgcacgggtgcgtaacacgtatgcaacctacctattattgggggatagcctttggaaacggagattaataccgcataatacgattgactggcatcagttgattgttaaagcttcggcgataatagatgggcatgcgtccaattagttagttggtgaggtaatggctcaccaagacgatgattggtaggggatctgagaggataatcccccacactggcactgagatacgggccagactcctacgggaggcagcagtagggaatattgggcaatgggcggaagcctgacccagccatgccgcgtgcaggatgaaggcgttatgcgttgtaaactgcttttttataggaagaaggaggccttgcgaggcttggtgacggtactataagaataagcaccggctaactccgtgccagcagccgcggtaatacggagggtgcgagcgttgtccggatttattgggtttaaagggtgcgtaggcggtttattaagtcagtggtgaaagacggtcgctcaacgattgcagtgccattgatactggtagacttgagttcgaatgaggtagctggaatggatagtgtagcggtgaaatgcatagatattatccagaacaccaattgcgaaggcaggttactaattcgatactgacgctgatgcacgaaagtgtggggatcaaacaggattagataccctggtagtccacactgtaaacgatgatgactaactgtttgcctttcggggtgagtggtacagagaaatcgttaagtcatccacctggggagtacgccggcaacggtgaaactcaaaggaattgacgggggtccgcacaagcggtggagcatgtggtttaattcgatgatacgcgaggaaccttacctaggctagaatgtgaagggatgtagtagagatattacagtctgcaaagacctgaaacaaggtgctgcatggctgtcgtcagctcgtgccgtgaggtgttgggttaagtcccgcaacgagcgcaacccctgttgttagttgccatcaagttaagttgggcactctagcaagactgcctacgcaagtagagaggaaggaggggacgacgtcaagtcatcatggcccttacgcctagggcaacacacgtgctacaatggacggtacagcgggtagctaccaggtaactggatgccaatctcgaaagccgttctcagttcggattggggtctgcaactcgaccctatgaagctggaatcgctagtaatcgggtatcagctatgacccggtgaatacgttcccggaccttgtacacaccgcccgtcaagccatgaaagtctggtagacctaaagctccgccttaaagccggagttagggtagaacaggtaattggggctaagtcgtaacaaggtagccgtaccggaaggtgtggctggaacacctcctt

SEQ ID NO: 3943 - DNA, 1563 bp, Flexistipes sinusarabici
  ref <308>: DATABASE ACCESSION NUMBER: NCBI ACCESSION: NC_015672.1
  ref <309>: DATABASE ENTRY DATE: 2019-04-01
  ref <313>: RELEVANT RESIDUES IN SEQ ID NO: (1)..(1563)
tttggatggagagtttgatcctggctcagaacgaacgctggcggcgtgcttaacacatgcaagtcagggggaatcctcccttcggggaggtagtacaccggcgcacgggtgagtaacgcgtgagtgacctacccattagacctggataacccggcgaaagttgggctaagacaggatgtgttaatacacttcatggtgtattgataaaggcaggtttcggcttgtgctaatggatgggctcgcgtctgattagctagttggtaaggtaaaggcttaccaaggcgacgatcattaggcggcctgagagggtggtcgcccacactggaactgagacacggtccagactcctacgggaggcagcagtggggaattttgcgcaatgggcgagagcctgacgcagcgacgccgcgtggacgaggaaggccttcgggtcgtaaagtccttttttacgggaagaaagttattaacagtaactggttaatatttgacggtaccgtaagaataagccccggctaactccgtgccagcagccgcggtaatacggagggggcgagcgttgttcggaattactgggcgtaaagcgtacgtaggcggcgtggtaagtcggaggttaaaggctacggctcaaccgtagtagggcctttgatactatcatgctagagtgtcggagggggtagcggaattccctgtgtagcggtgaaatgcgtagatatagggaagaacaccagtagcgaaggcggctacctggccgatcactgacgctgaggtacgagagcgtgggtagcaaacaggattagataccctggtagtccacgctgtaaacgatggacgctaggtgttggaggaaccgaccccttcagtgccgaagccaacgcgttaagcgtcccgcctggggagtacgaccgcaaggttaaaactcaaaggaattgacgggggcccgcacaagcggtggagcacgtggtttaattcgatgctaaccgaagaaccttacctggtcttgacatcctccggagggactagagatagttctgtgcccgcctttggcgggagcggagagacaggtgctgcatggctgtcgtcagctcgtgccgtgaggtgttgggttaagtcccgcaacgagcgcaacccctattcatagttgccatcggtaaggccgggcactctatggatactgcccgtgataaacgggaggaaggtggggacgacgtcaagtcatcatggcctttatgaccagggctacacacgtgctacaatggtacgtacagagggcagcgaagccgcgaggtgtagcgaatccctaaaagcgtgccttagttcggattgtagtctgcaattcgactacatgaaggcggaatcgctagtaatcgcaggtcagcaaaactgcggtgaatacgttcccgggccttgtacacaccgcccgtcacaccacgggagttggttgtacctgaagccggtggcccaactgcggagggagccgtttatggtatgactggcaactggggtgaagtcgtaacaaggtagccgtaccggaaggtgtggctggatcacctcctttctaaggaa

SEQ ID NO: 3944 - DNA, 1518 bp, Flexithrix dorotheae
  ref <308>: DATABASE ACCESSION NUMBER: NCBI ACCESSION: NZ_KB903456.1
  ref <309>: DATABASE ENTRY DATE: 2019-04-01
  ref <313>: RELEVANT RESIDUES IN SEQ ID NO: (1)..(1518)
ggagagtttgatcctggctcaggatgaacgctagcggcaggcctaatacatgcaagtcgaggggcagcacgggacttcggttctggtggcgaccggcgcacgggtgcgtaacgcgtatgcaacctacccacaacaggaggatagccctcggaaacgaggattaatattccataaaacaggggtactacctggtactatttgttaaagcttcggtggttgtggatgggcatgcgtcccattagctagatggcgaggtaacggctcaccatggcgatgatgggtaggggttctgagaggatgatcccccacactggtactgagacacggaccagactcctacgggaggcagcagtagggaatattgggcaatgggcgaaagcctgacccagccatgccgcgtgaacgaagaaggctctcgggtcgtaaagttcttttatacggggagaacactgctatgcgtagcagcttgacggtaccgtatgaataagcaccggctaactccgtgccagcagccgcggtaatacggagggtgcaagcgttgtccggatttattgggtttaaagggtacgtaggcggcttattaagtcagtggtgaaagtttgcagcttaactgtaaaagtgccattgatactggtaagcttgagtactgtagaggtgggcggaattccgcatgtagcggtgaaatgcatagatatgcggaggaacaccaaaagcgaaggcagctcactggacagtaactgacgctgaggtacgaaagcgtggggatcgaacaggattagataccctggtagtccacgctgtaaacgatggtaactaggtgtgcgcgatatacagtgcgtgcccaagcgaaagcgataagttacccacctggggagtacgctcgcaagagtgaaactcaaaggaattgacgggggtccgcacaagcggtggagcatgtggtttaattcgatgatacgcgaggaaccttacctggactagaatgcgagtgacgtaccgagagatcggtattccttcgggcacaaagcaaggtgctgcatggctgtcgtcagctcgtgccgtgaggtgttgggttaagtcccgcaacgagcgcaacccctactcttagttgccatcaggttaagctggggactctaagaggactgcctgcgcaagcagagaggaaggaggggacgatgtcaagtcatcatggcccttacgtccagggctacacacgtgctacaatggccggtacagagggttgctacctggtaacaggatgccaatctcaaaaagccggtctcagttcggattgaggtctgcaactcgacctcatgaagttggaatcgctagtaatcgcatatcagcaatgatgcggtgaatacgttcccggaccttgtacacaccgcccgtcaagccatgggagttgggtgtacctgaagatggtgaccgtcaaaggagccgtttagggtaaaactagcgactggggctaagtcgtaacaaggtagccgtaccggaaggtgtggctggaacacctccttt

SEQ ID NO: 3945 - DNA, 1532 bp, Flexivirga sp. BO-16
  ref <308>: DATABASE ACCESSION NUMBER: NCBI ACCESSION: NZ_RJJQ01000039.1
  ref <309>: DATABASE ENTRY DATE: 2019-04-01
  ref <313>: RELEVANT RESIDUES IN SEQ ID NO: (1)..(1532)
tggagagtttgatcctggctcaggacgaacgctggcggcgtgcttaacacatgcaagtcgaacgatgatgcctgagcttgcttgggtggattagtggcgaacgggtgagtaacacgtgagtaacctgccctcctctttgggataagccttggaaacggggtctaataccgaatattcacattgtgccgcatggtgtggtgtggaaagtttttgtggtgggggatggactcgcggcctatcagcttgatggtggggtagtggcctaccatggctttgacgggtagccggcctgagagggtgaccggccacactgggactgagacacggcccagactcctacgggaggcagcagtggggaatattgcacaatgggcggaagcctgatgcagcgacgccgcgtgggggatgacggccttcgggttgtaaactcctttcagcagggacgaagctttttgtgacggtacctgcagaagaagcaccggctgactacgtgccagcagccgcggtaatacgtagggtgcgagcgttgtccggaattattgggcgtaaagagcttgtaggcggtttgtcgcgtctgccgtgaaagcccagggcttaaccctgggtctgcggtgggtacgggcaggctagagtgtggtaggggagactggaattcctggtgtagcggtgaaatgcgcagatatcaggaggaacaccgatggcgaaggcaggtctctgggccactactgacgctgagaagcgaaagcatggggagcgaacaggattagataccctggtagtccatgccgtaaacgttgggcgctaggtgtgggactcattccacgagttccgtgccgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaatgtgccagagatggtgcagcctttgggctggtgtacaggtggtgcatggttgtcgtcagctcgtgtcgtgagatgttgggttaagtcccgcaacgagcgcaaccctcgttccatgttgccagcacgtgatggtggggactcatgggagactgccggggtcaactcggaggaaggtggggatgacgtcaaatcatcatgccccttatgtcttgggcttcacgcatgctacaatggctggtacagagggttgcgatgccgtgaggtggagcgaatcccttaaaactggtctcagttcggattggggtctgcaactcgaccccatgaagttggagtcgctagtaatcgcagatcagcaacgctgcggtgaatacgttcccgggccttgtacacaccgcccgtcaagtcacgaaagtcggtaacacccgaagcccatggcctaaccaggttttcctggggggagtggtcgaaggtggggttggcgattgggactaagtcgtaacaaggtagccgtaccggaaggtgcggctggatcacctcctttctaagga

SEQ ID NO: 3946 - DNA, 1555 bp, Floricoccus penangensis
  ref <308>: DATABASE ACCESSION NUMBER: NCBI ACCESSION: NZ_MKIQ01000009.1
  ref <309>: DATABASE ENTRY DATE: 2019-04-01
  ref <313>: RELEVANT RESIDUES IN SEQ ID NO: (1)..(1555)
tttatgagagtttgatcctggctcaggacgaacgctggcggcgtgcctaatacatgcaagttgagcgctgaagactggtacttgtaccggttggatgagcagcgaacgggtgagtaacgcgtgggtaacctgccctatagagggggataactagaggaaactttagctaataccgcataaaatctaataacacatgttataagattgaaagtgccaactggtacactataggatggacccgcgttgtattagctagttggtgaggtaatagctcaccaaggcgatgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgtaagagaagaacaccagtaagagtggaaagcttactggctgacggtatcttaccagaaagccacggctaactacgtgccagcagccgcggtaatacgtaggtggcaagcgttgtccggatttattgggcgtaaagcgagcgcaggcggttcattaagtctgatgtaaaaggcagtggctcaaccattgtaagcattggaaactggtgaacttgagtgcagtagaggagagtggaattccatgtgtagcggtgaaatgcgtagatatatggaggaacaccggaggcgaaagcggctctctggactgtaactgacgctgaggctcgaaagcgtggggagcaaacaggattagataccctggtagtccacgccgtaaacgatgagtgctagatgttcgggggtatccacccctgagtgtcgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatggatgctatccctagagatagggagttacttcggtacatccaatacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatgggaagtacaacgagtcgcaagccggtgacggcaagctaatctcttaaagcttctctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 3947 - DNA, 1555 bp, Floricoccus tropicus
  ref <308>: DATABASE ACCESSION NUMBER: NCBI ACCESSION: NZ_MKIR01000005.1
  ref <309>: DATABASE ENTRY DATE: 2019-04-01
  ref <313>: RELEVANT RESIDUES IN SEQ ID NO: (1)..(1555)
tttatgagagtttgatcctggctcaggacgaacgctggcggcgtgcctaatacatgcaagttgagcgctgaagactggtacttgtaccggttggatgagcagcgaacgggtgagtaacgcgtgggtaacctgccctatagagggggataactagaggaaactttagctaataccgcataaaatctaataacacatgttataagattgaaagtgccaactggtacactataggatggacccgcgttgtattagctagttggtgaggtaaaggctcaccaaggcgatgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgtaagagaagaacaccagtaagagtggaaagcttactggctgacggtatcttaccagaaagccacggctaactacgtgccagcagccgcggtaatacgtaggtggcaagcgttgtccggatttattgggcgtaaagcgagcgcaggcggttcattaagtctgatgtaaaaggcagtggctcaaccattgtaagcattggaaactggtgaacttgagtgcagtagaggagagtggaattccatgtgtagcggtgaaatgcgtagatatatggaggaacaccggaggcgaaagcggctctctggactgtaactgacgctgaggctcgaaagcgtggggagcaaacaggattagataccctggtagtccacgccgtaaacgatgagtgctagatgttcgggggtatccacccctgagtgtcgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatggatgctatccctagagatagggagttacttcggtacatccaatacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatgggaagtacaacgagtcgcaagccggtgacggcaagctaatctcttaaagcttctctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 3948 - DNA, 1546 bp, Fluoribacter bozemanae
  ref <308>: DATABASE ACCESSION NUMBER: NCBI ACCESSION: NZ_UGGY01000001.1
  ref <309>: DATABASE ENTRY DATE: 2019-04-01
  ref <313>: RELEVANT RESIDUES IN SEQ ID NO: (1)..(1546)
gaactgaagagtttgatcctggctcagattgaacgctggcggcatgcttaacacatgcaagtcgaacggcagcatgacctagcttgctaggttgatggcgagtggcgaacgggtgagtaacgcgtaggaatatgccttgaagtgggggacaacttggggaaactcaagctaataccgcatgatgtctaaggacgaaagctggggaccttttaggcctggcgctttaagattagcctgcgtccgattagctagttggtggggtaagggcctaccaaggcgacgatcggtagctggtctgagaggatgaccagccacactggaactgagacacggtccagactcctacgggaggcagcagtggggaatattggacaatggggggaaccctgatccagcaatgccgcgtgtgtgaagaaggcctgagggttgtaaagcactttcagtggggaggaggtttgctaggttaagagctaggcgaatggacgttacccacagaagaagcaccggctaactccgtgccagcagccgcggtaatacggagggtgcgagcgttaatcggaattactgggcgtaaagcgtgcgtaggtggttgattaagttatctgtgaaatccctgggcttaacctgggcaggtcagatgatactggttgactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggttatatgaaaataattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttgtccttagttgccagcacgtgaaggtgggaactctaaggagactgccggtgacaaaccggaggaaggcggggatgacgtcaagtcatcatggcccttacgggtagggctacacacgtgctacaatgggcgatacagagggaagcgaaggggtgacctggagctaatcttagaaagtcgttcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccttcggggggacgtttaccacggtgtggttcatgactggggtgaagtcgtaacaaggtagccgtaggggaacctgcggctggatcacctccttaa

SEQ ID NO: 3949 - DNA, 1536 bp, Fluviicola taffensis
  ref <308>: DATABASE ACCESSION NUMBER: NCBI ACCESSION: NC_015321.1
  ref <309>: DATABASE ENTRY DATE: 2019-04-01
  ref <313>: RELEVANT RESIDUES IN SEQ ID NO: (1)..(1536)
tttttacaacggagagtttgatcctggctcaggatgaacgctagcggcaggcctaacacatgcaagtcgaggggtagcaggataaagcttgctttattgctgacgaccggcgcacgggtgcgtaacgcgtatgcaacctaccttatactggggtatagcccggagaaattcggattaatcccccatagtattattgaatcgcatggtttgataattaaaggttacggtataagatgggcatgcgtcccattagctagatggtgaggtaacggctcaccatggcgacgatgggtagggggcctgagagggtggtcccccacactggtactgagacacggaccagactcctacgggaggcagcagtgaggaatattggtcaatgggcgcaagcctgaaccagccatgccgcgtgcaggaagacggtcctatggattgtaaactgcttttattagggaataaacctctttacgtgtagagagctgaaggtacctaatgaataagcaccggctaactccgtgccagcagccgcggtaatacggagggtgcaagcgttatccggaatcattgggtttaaagggtccgcaggcggtcttataagtcagtggtgaaatcctacagctcaactgtagaactgccattgatactgtaagacttgaattcgatcgaagtgggcggaatatgacatgtagcggtgaaatgcttagatatgtcatagaacaccgatagcgaaggcagctcactaggtctggattgacgctcagggacgaaagcgtggggagcaaacaggattagataccctggtagtccacgccgtaaactatcaatactcgttctcagccctttaggggttggggaccaagcgaaagtgataagtattgcacctggggagtacgatcgcaaggttgaaactcaaaggaattgacgggggcccgcacaagcggtggagcatgtggtttaattcgatgatacgcgaggaaccttaccagggcttaaatgtagagggaatatagtggaaacattatagtcttcggaccgtctacaaggtgctgcatggctgtcgtcagctcgtgccgtgaggtgttgggttaagtcccgcaacgagcgcaacccctatctttagttgccagcgagtcatgtcggggactctaaagaaactgcctacgcaagtagtgaggaaggcggggacgacgtcaagtcatcacggcccttacgtcctgggccacacacgtgctacaatggtcggtacagagggcagctacctagcgataggatgcgaatctcgaaagccgatctcagttcggattggagtctgcaactcgactctatgaagctggaatcgctagtaatcgcgcatcagccatggcgcggtgaatacgttcccgggccttgtacacaccgcccgtcaaacaatggaagctgggggtgcctgaagtcggtaaccgtaaggagctgcctagggtaaaactagtaactggtgttaagtcgtaacaaggtagccgtaccggaaggtgcggctggaacatctcctttctagag

SEQ ID NO: 3950 - DNA, 1504 bp, Fodinicurvata fenggangensis
  ref <308>: DATABASE ACCESSION NUMBER: NCBI ACCESSION: NZ_JMLV01000008.1
  ref <309>: DATABASE ENTRY DATE: 2019-04-01
  ref <313>: RELEVANT RESIDUES IN SEQ ID NO: (1)..(1504)
gaggttaatgtgagagtttgatcctggctcagaacgaacgctggcggcaggcctaacacatgcaagtcgaacgcatgccttcgggcatgagtggcgcacgggtgagtaacgcgtgggaaccgaccctggggttggggataaccgctggaaacggcggctaatacccaatacgccttgagggggaaagatttatcgccccgggacgggcccgcgttggattaggtagttggtggggtaacggcctaccaagcctacgatccatagctggtttgagaggatgatcagccacactgggactgagacacggcccagactcctacgggaggcagcagtggggaatattggacaatgggggcaaccctgatccagccatgccgcgtgagtgaagaaggccttagggttgtaaagctctttcagtggtgaagatgatgacggtagccacagaagaagccccggctaactccgtgccagcagccgcggtaatacggagggggcaagcgttgttcggaattactgggcgtaaagggcgcgtaggcggatattcaagtcagaggtgaaagccctgggctcaacctgggaatggcctttgaaactggatgtctggagttcgggagaggtgagcggaatacccagtgtagaggtgaaattcgtagatattgggtagaacaccggtggcgaaggcggctcactggcccgcaactgacgctgaggcgcgaaagcgtggggagcaaacaggattagataccctggtagtccacgccgtaaacgatgtgtgctagccgttgggatgctttgcatttcagtggcgcagctaacgcgataagcacaccgcctggggagtacggtcgcaagattaaaactcaaaggaattgacgggggcccgcacaagcggtggagcatgtggtttaattcgaagcaacgcgcagaaccttaccagcccttgacatgggcgtcgcgggatccggagacgggtcctttcagttcggctggacgccacacaggtgctgcatggctgtcgtcagctcgtgtcgtgagatgttgggttaagtcccgcaacgagcgcaacccttaccctcagttgccagcggttttggccgggcactctggggggactgccggtgacaagccggaggaaggcggggatgacgtcaagtcctcatggcccttatgggctgggctacacacgtgctacaatggcggtgacagtgggcagcgagggcgcgagcctgagcgaatctccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggctttacccgaagacggtgcgctaacccgcaagggaggcagccggccacggtaaggtcagcgactggggtgaagtcgtaacaaggtagccgtaggggaacctgcggctggatcacctcctttctaagg

SEQ ID NO: 3951 - DNA, 1498 bp, Fodinicurvata sediminis
  ref <308>: DATABASE ACCESSION NUMBER: NCBI ACCESSION: NZ_ATVH01000016.1
  ref <309>: DATABASE ENTRY DATE: 2019-04-01
  ref <313>: RELEVANT RESIDUES IN SEQ ID NO: (1)..(1498)
aatgtgagagtttgatcctggctcagaacgaacgctggcggcaggcctaacacatgcaagtcgaacgcatgccttcgggcatgagtggcgcacgggtgagtaacgcgtgggaaccgaccctggggtaggggataaccgctggaaacggcggctaataccctatacgccttgagggggaaagatttatcgccctgggacgggcccgcgttggattaggtagttggtggggtaatggcctaccaagcctgcgatccatagctggtttgagaggatgatcagccacactgggactgagacacggcccagactcctacgggaggcagcagtggggaatattggacaatgggggcaaccctgatccagccatgccgcgtgagtgaagaaggccttagggttgtaaagctctttcagtggtgaagatgatgacggtagccacagaagaagccccggctaactccgtgccagcagccgcggtaatacggagggggcaagcgttgttcggaattactgggcgtaaagggcgcgtaggcggatattcaagtcagaggtgaaagccccgggctcaacctgggaattgcctttgaaactggatgtctggagttcgggagaggtgagcggaatacccagtgtagaggtgaaattcgtagatattgggtagaacaccggtggcgaaggcggctcactggcccgcaactgacgctgaggcgcgaaagcgtggggagcaaacaggattagataccctggtagtccacgccgtaaacgatgtgtgctagccgttgggatgctttgcatttcagtggcgcagctaacgcgataagcacaccgcctggggagtacggtcgcaagattaaaactcaaaggaattgacgggggcccgcacaagcggtggagcatgtggtttaattcgaagcaacgcgcagaaccttaccagcccttgacatgggcgtcgcgggtagtggagacgctacccatcagttcggctggacgccgcacaggtgctgcatggctgtcgtcagctcgtgtcgtgagatgttgggttaagtcccgcaacgagcgcaacccttaccctcagttgccagcggttttggccgggcactctggggggactgccggtgacaagccggaggaaggcggggatgacgtcaagtcctcatggcccttatgggctgggctacacacgtgctacaatggcggtgacagtgggcagcgagggcgcgagcctgagcgaatctccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggctttacccgaagacggtgcgctaacccgcaagggaggcagccggccacggtaaggtcagcgactggggtgaagtcgtaacaaggtagccgtaggggaacctgcggctggatcacctcctttctaagg

SEQ ID NO: 3952 - DNA, 345 bp, Fontibacillus panacisegetis
  ref <308>: DATABASE ACCESSION NUMBER: NCBI ACCESSION: NZ_FNBG01000052.1
  ref <309>: DATABASE ENTRY DATE: 2019-04-01
  ref <313>: RELEVANT RESIDUES IN SEQ ID NO: (1)..(345)
tttaatggagagtttgatcctggctcaggacgaacgctggcggcgtgcctaatacatgcaagtcgagcggacttgatggagagcttgctctcctgatagttagcggcggacgggtgagtaacacgtaggcaacctgcctgtaagaccgggataactagcggaaacgttagctaataccggataatttatttcatcgcatggtggaataatgaaagacggagcaatctgtcacttacggatgggcctgcggcgcattagctagttggtggggtaaaggcctaccaaggcgacgatgcgtagccgacctgagagggtgaacggccacactgggactgagacacggcc

SEQ ID NO: 3953 - DNA, 311 bp, Fontibacillus phaseoli
  ref <308>: DATABASE ACCESSION NUMBER: NCBI ACCESSION: NZ_QPJW01000010.1
  ref <309>: DATABASE ENTRY DATE: 2019-04-01
  ref <313>: RELEVANT RESIDUES IN SEQ ID NO: (1)..(311)
tttattggagagtttgatcctggctcaggacgaacgctggcggcgtgcctaatacatgcaagtcgagcggacttgatggagagcttgctctccggatagttagcggcggacgggtgagtaacacgtaggtaacctgcctgtaagactgggataactaccggaaacggtagctaataccggataatttatttcttcgcatggagagataatgaaagacggttctgatctaatcagggctgtcacttacggatgggcctgcggcgcattagctagttggtggggtaacggctcaccaaggcgacgatgcgtag

SEQ ID NO: 3954 - DNA, 1488 bp, Fortiea contorta
  ref <308>: DATABASE ACCESSION NUMBER: NCBI ACCESSION: NZ_KB235930.1
  ref <309>: DATABASE ENTRY DATE: 2019-04-01
  ref <313>: RELEVANT RESIDUES IN SEQ ID NO: (1)..(1488)
aaaacggagagtttgatcctggctcaggatgaacgctggcggtatgcttaacacatgcaagtcgaacggaatcttcggatttagtggcggacgggtgagtaacgcgtgagaatctggcttcaggtcggggacaaccactggaaacggtggctaataccggatgtgccgaaaggtaaaaggcttgctgcctgaagatgagctcgcgtctgattagctagttggtagagtaagagcctaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggtcgtaaacctcttttctcaaggaagaataaaatgacggtacttgaggaataagcatcggctaactccgtgccagcagccgcggtaatacggaggatgcaagcgttatccggaatgattgggcgtaaagcgtccgcaggtggctgtgtaagtctgctgttaaagagcaaagctcaactttgtaaaagcagtggaaactacacggctagagtgcgttcggggcagagggaattcctggtgtagcggtgaaatgcgtagagatcaggaagaacaccggtggcgaaagcgctctgctaggccgcaactgacactgagggacgaaagctaggggagcgaatgggattagataccccagtagtcctagccgtaaacgatggatactaggcgtggcttgtatcgacccgagccgtgccggagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaattggagtgaaagcttcaagtgccttcgggagcgcgaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcagcatgccccttacgtcttgggctacacacgtactacaatgctacggacagagggcagcaagctagcgatagcaagcaaatcccggaaaccgtagctcagttcagatcgaaggctgcaactcgccttcgtgaaggaggaatcgctagtaattgcaggtcagcatactgcagtgaattcgttcccgggccttgtacacaccgcccgtcacaccatggaagctggcaacgcccgaagtcattactccaacctacgggaggaggatgcctaaggcagtgctggtgactggggtgaagtcgtaacaaggtagccgtaccggaaggtgtggctggatcacctcctttt

SEQ ID NO: 3955 - DNA, 1546 bp, Francisellaceae bacterium SYSU WZ-2
  ref <308>: DATABASE ACCESSION NUMBER: NCBI ACCESSION: NZ_QLIS01000011.1
  ref <309>: DATABASE ENTRY DATE: 2019-04-01
  ref <313>: RELEVANT RESIDUES IN SEQ ID NO: (1)..(1546)
aaactgaagagtttgatcctggctcagattgaacgctggtggcatgcttaacacatgcaagtcgaacggtaacaggactagcttgctagttgctgacgagtggcggacgggtgagtaacgcgtaggaatctacctatgggagggggataccaactggaaacggttgttaataccgcataatacctaagggttaaaggtggctttcgggctgccgctcatggatgagcctgcgttggattagctagttggtggggtaagggcccaccaaggctacgatccatagctgatttgagaggatgatcagccacattgggactgagacacggcccaaactcctacgggaggcagcagtggggaatattggacaatgggggaaaccctgatccagcaatgccatgtgtgtgaagaaggctctagggttgtaaagcactttagttggggaggaaggtcaatatgttaatagcattttgaattgacgttacccaaagaataagcaccggctaactccgtgccagcagccgcggtaatacggggggtgcaagcgttaatcggaattactgggcgtaaagggtctgtaggtggtatgttaagtcagatgtgaaagcccagggctcaaccttggaactgcatttgatactggcaaactagagtacggtagaggaatggggaatttctggtgtagcggtgaaatgcgtagagatcagaaggaacaccaatggcgaaggcaacattctggaccgatactgacactgagggacgaaagcgtggggatcaaacaggattagataccctggtagtccacgctgtaaacgatgagtactagctgttgggttcggtgtaaagggcctagtggcgcagctaacgcgttaagtactccgcctggggactacggccgcaaggctaaaactcaaaggaattgacggggacccgcacaagcggtggagcatgtggtttaattcgatgcaacgcgaagaaccttacctggtcttgacatcctgcgaactttctagagatagattggtgccttcgggaacgcagtgacaggtgctgcacggctgtcgtcagctcgtgttgtgaaatgttgggttaagtcccgcaacgagcgcaacccctattgatagttaccatcattaagttgggtactctattgagactgccgctgacaaggcggaggaaggtggggacgacgtcaagtcatcatggcccttacgaccagggctacacacgtgctacaatgggtattacagagggctgcgaaggggcgacctggagcgaaactcacaaaggtactcttagtccggattgcagtctgcaactcgactgcatgaagtcggaatcgctagtaatcgcgaatcagaatgtcgcggtgaatacgttcccgggtcttgtacacaccgcccgtcacaccatgggagtgggttgcaccagaagtagttaggctaaccgcaaggaggccgattaccacggtgtgattcatgactggggtgaagtcgtaacaaggtagccgtaggggaacctgcggctggatcacctccttaaaggaaat

SEQ ID NO: 3956 - DNA, 457 bp, Franconibacter pulveris
  ref <308>: DATABASE ACCESSION NUMBER: NCBI ACCESSION: NZ_LFEJ01000026.1
  ref <309>: DATABASE ENTRY DATE: 2019-04-01
  ref <313>: RELEVANT RESIDUES IN SEQ ID NO: (1)..(457)
ttaattgaagagtttgatcatggctcagattgaacgctggcggcaggcctaacacatgcaagtcgagcggtaacagggatcagcttgctgattcgctgacgagcggcggacgggtgagtaatgtctgggaaactgcctgatggagggggataaccactggaaacggtggctaataccgcataacgtcgcaagaccaaagtgggggaccttcgggcctcatgccatcagatgtgcccagatgggattagcttgtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcg

SEQ ID NO: 3957 - DNA, 338 bp, Frankia asymbiotica
  ref <308>: DATABASE ACCESSION NUMBER: NCBI ACCESSION: NZ_MOMC01000070.1
  ref <309>: DATABASE ENTRY DATE: 2019-04-01
  ref <313>: RELEVANT RESIDUES IN SEQ ID NO: (1)..(338)
gatggagagtttgatcctggctcaggacgaacgctggcggcgtgcttaacacatgyaagtcgagcggaccttcgggtcagcggcgaacgggtgagtaacacgtgggcaacctgccccaggctctggaataactccgggaaaccggggctaatgccggatattcacagtaccgggcatctggtggtgtggaaagatttattggcttgggatgggcccgcggcctatcagcttgttggtggggtaatggcctaccaaggcgacgacgggtagccggcctgagagggcgatcggccacactgggactgagacacggcccagactcctacgggaggcagcag

SEQ ID NO: 3958 - DNA, 1513 bp, Frankia sp. BMG5.36
  ref <308>: DATABASE ACCESSION NUMBER: NCBI ACCESSION: NZ_MBLO01000150.1
  ref <309>: DATABASE ENTRY DATE: 2019-04-01
  ref <313>: RELEVANT RESIDUES IN SEQ ID NO: (1)..(1513)
gatggagagtttgatcctggctcaggacgaacgctggcggcgtgcttaacacatgcaagtcgagcggaccttcgggtcagcggcgaacgggtgagtaacacgtgggcaacctgccccaggctctggaataactccgggaaaccggggctaatgccggatattcacaccttcgggcatctggtggtgtggaaagatttattggcttgggatgggcccgcggcctatcagcttgttggtggggtagtggcccaccaaggcgacgacgggtagccggcctgagagggcgatcggccacactgggactgagacacggcccagactcctacgggaggcagcagtggggaatattgcgcaatgggcgaaagcctgacgcagcgacgccgcgtgagggatgacggccttcgggttgtaaacctctttcagcagggacgaagcgcaagtgacggtacctgcagaagaagcaccggccaactacgtgccagcagccgcggtaatacgtagggtgcaagcgttgtccggaattattgggcgtaaagagctcgtaggcggcctgtcgcgtcggctgtgaaaacccggggctcaaccccgggcctgcagtcgatacgggcaggctagagtccggtaggggagactggaattcctggtgtagcggtgaaatgcgcagatatcaggaggaacaccggtggcgaaggcgggtctctgggccggaactgacgctaaggagcgaaagcgtggggagcgaacaggattagataccctggtagtccacgccgtaaacgttgggcgctaggtgtgggggaccttccacggcctccgtgccgcagctaacgcattaagcgccccgcctggggagtacggccgcaaggctaaaactcaaaggaattgacgggggcccgcacaagcggcggagcatgtggcttaattcgatgcaacgcgaagaaccttaccagggcttgacatgcggggaaatccatcagagatggtgggtccttaggggtcccgtacaggtggtgcatggctgtcgtcagctcgtgtcgtgagatgttgggttaagtcccgcaacgagcgcaacccttgtcctatgttgccagcgagttatgtcggggactcataggagactgccggggtcaactcggaggaaggtggggacgacgtcaagtcatcatgccccttacgtcctgggctgcacacatgctacaatggccggtacaatgggctgcgataccgcgaggtggagcgaatcccaaaaagccggtctcagttcggatcggggtctgcaactcgaccccgtgaagtcggagtcgctagtaatcgcagatcagcattgctgcggtgaatacgttcccgggccttgtacacaccgcccgtcacgtcatgaaagtcggtaacacccgaagccggtggcctaacccttgtggagggagccgtcgaaggtgggaccggcgattaggacgaagtcgtaacaaggtagccgtaccggaaggtgcggctggatcacctcctttctaaggag

SEQ ID NO: 3959 - DNA, 355 bp, Frankia sp. EUN1h
  ref <308>: DATABASE ACCESSION NUMBER: NCBI ACCESSION: NZ_MBLN01000032.1
  ref <309>: DATABASE ENTRY DATE: 2019-04-01
  ref <313>: RELEVANT RESIDUES IN SEQ ID NO: (1)..(355)
gatggagagtttgatcctggctcaggacgaacgctggcggcgtgcttaacacatgcaagtcgagcggaccttcgggtcagcggcgaacgggtgagtaacacgtgggcaacctgccccaggctctggaataactccgggaaaccggggctaatgccggatattcacacctttgggcatctggtggtgtggaaagatttattggcttgggatgggcccgcggcctatcagcttgttggtggggtaatggcctaccaaggcgacgacgggtagccggcctgagagggcgatcggccacactgggactgagacacggcccagactcctacgggaggcagcagtggggaatattgcgcaa

SEQ ID NO: 3960 - DNA, 243 bp, Frankia sp. KB5
  ref <308>: DATABASE ACCESSION NUMBER: NCBI ACCESSION: NZ_MRUJ01000369.1
  ref <309>: DATABASE ENTRY DATE: 2019-04-01
  ref <313>: RELEVANT RESIDUES IN SEQ ID NO: (1)..(243)
ttgatggagagtttgatcctggctcaggacgaacgctggcggcgtgcttaacacatgcaagtcgagcggggagcttcggctctcagcggcgaacgggtgagtaacacgtgggcaacctgccccgagctctggaataacctcgggaaaccggggctaatgccggatatgacattgccgggcatctggtggtgtggaaagatttatcggctcgggatgggcccgcggcctatcagcttgttggtg

SEQ ID NO: 3961 - DNA, 204 bp, Frankia sp. NRRL B-16219
  ref <308>: DATABASE ACCESSION NUMBER: NCBI ACCESSION: NZ_MAXA01000223.1
  ref <309>: DATABASE ENTRY DATE: 2019-04-01
  ref <313>: RELEVANT RESIDUES IN SEQ ID NO: (1)..(204)
ttgatggagagtttgatcctggctcaggacgaacgctggcggcgtgcttaacacatgcaagtcgagcgaggagcttgctcctagcggcgaacgggtgagtaacacgtgggcaacctgccccaagctctggaataactccgggaaaccggggctaatgccggatatgacatcatcgggcatctggtgatgtggaaagatttatcg

SEQ ID NO: 3962 - DNA, 1455 bp, Frankiales bacterium YIM 75000
  ref <308>: DATABASE ACCESSION NUMBER: NCBI ACCESSION: NZ_QZEZ01000016.1
  ref <309>: DATABASE ENTRY DATE: 2019-04-01
  ref <313>: RELEVANT RESIDUES IN SEQ ID NO: (1)..(1455)
tccactcttcggggtggggttagtggcgaacgggtgagtaacacgtgagcaacctgcccctggctctgggataaccacgggaaaccgtggctaataccggatatgactgcctgctgcatggtgggtggtggaaagtttttcggctggggatgggctcgcggcctatcagcttgttggtggggtgatggcctaccaaggcgacgacgggtagccggcctgagagggcgaccggccacactgggactgagacacggcccagactcctacgggaggcagcagtggggaatattgcgcaatgggcggaagcctgacgcagcgacgccgcgtgggggatgacggccttcgggttgtaaacctctttcagcgccgaagaagcgtaagtgacggtaggcgcagaagaagcaccggctaactacgtgccagcagccgcggtaatacgtagggtgcaagcgttgtccggaattattgggcgtaaagagctcgtaggcggtttgtcgcgtcggatgtgaaagcccggggctcaactccgggtctgcattcgatacgggcagactagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacgttgggcgctaggtgtgggatcccttccacgggttccgtgccgcagctaacgcattaagcgccccgcctggggagtacggccgcaaggctaaaactcaaaggaattgacgggggcccgcacaagcggcggagcatgtggcttaattcgacgcaacgcgaagaaccttaccaaggcttgacatcgccggtaatcctccagagatggggggtcccttgtgggccggtgacaggtggtgcatggttgtcgtcagctcgtgtcgtgagatgttgggttaagtcccgcaacgagcgcaaccctcgttccatgttgccagcgggttatgccggggactcatgggagactgccggggtcaactcggaggaaggtggggatgacgtcaaatcatcatgccccttatgtcttgggctgcacacatgctacaatggccggtacaaagggctgctaagccgtgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggtaacacccgaagccggtggcccaacccttgtggggggagctgtcgaaggtgggatcggcgattgggacgaagtcgtaacaaggtagccgtaccggaaggtgcggctggatcacctcctttctaaggag

SEQ ID NO: 3963 - DNA, 1526 bp, Fretibacterium sp. OH1220 COT-178
  ref <308>: DATABASE ACCESSION NUMBER: NCBI ACCESSION: NZ_RQYL01000001.1
  ref <309>: DATABASE ENTRY DATE: 2019-04-01
  ref <313>: RELEVANT RESIDUES IN SEQ ID NO: (1)..(1526)
tactgagagtttgatcctggctcaggacgaacgctggcggcgtgcgtaacacatgcaagttgaacgacggtgtcatgaagtggtaacacggattggcatacggagtagcggacgggtgagtacaacatgagaagctgtccaatagcgggggataacgttcggaaacggaccctaataccccataggccttttggttaaagcagcgatgcgctattggaggtgctcgtgtcctatcagctggttggtgaggtaacggctcaccaaggcgacgacgggtagccggcctgagagggtgtccggccacactggaactgagatacggtccagactcctacgggaggcagcagtggggaatattgggcaatgggagaaatcctgacccagcgacgccgcgtgaacgaagaaggccttcgggtcgtaaagttcttttatgtgggaagaaggaagtgacggtaccacatgaataagccccggctaactacgtgccagcagccgcggtaatacgtagggggcgagcgttgtccggaattactgggcgtaaagggcacgcaggctgtgcttcaagtcagctgttaaaggatgcggcttaaccgtgttatgcagttgagactgaggtgctggagtgccgtagaggcaagtggaattcccagtgtagcggtgaaatgcgtagatattgggaagaacatcggtggcgaaggcgacttgctggacggtaactgacgctgaggtgcgaaagccaggggagcaaacgggattagataccccggtagtcctggctgtaaacgatgaatgctaggtgtgcgagcagagatgttggtgtgccgcagttaacgcgataagcattccgcctggggagtacggtcgcaagattgaaactcaaaggaattgacgggggcccgcacaagcggtggagcacgtggtttaattcgatgcaaaccgaagaaccttacctgggtttgacatgtacgtggtaggagtctgaaaggatgacgacgctgccttcgggcagtgagcgtacacaggtgctgcatggctgtcgtcagctcgtgtcgtgagatgttgggttaagtcccgcaacgagcgcaacccctgcgattagttgccagcgattcggtcgggcactctaatgggactgccatcgacaagatggaggaaggtggggacgacgtcaagtcatcatggcccttatgtccagggcgacacacgtgctacaatggtcggtacagagggaagcgaggttgtgaggccgagcggatcccgaaaagccgatctcagttcggattgaagtctgcaattcgacttcatgaagctggaatcgctagtaatcgcagatcagccaagctgcggtgaatacgttcccgggccttgtacacaccgcccgtcacaccacccgagccgggtgtacccgaagccggtggcctaaccttatgggaggagccgtcgaaggtgtgtctggtgaggggggtgaagtcgtaacaaggtagccgtaccggaaggtgcggctggatcacctcctttctaaggag

SEQ ID NO: 3964 - DNA, 1529 bp, Frigoribacterium sp. PhB107
  ref <308>: DATABASE ACCESSION NUMBER: NCBI ACCESSION: NZ_RJKU01000006.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacgatgaactccagcttgctggggggattagtggcgaacgggtgagtaacacgtgagtaacctgcccttgactctgggataagcgctggaaacggcgtctaataccggatacgagcttcagccgcatggctaggagttggaaagaattttggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacggccagagatggccgccccgcaaggtcggtatacaggtggtgcatggttgtcgtcagctcgtgtcgtgagatgttgggttaagtcccgcaacgagcgcaaccctcgttctatgttgccagcacgtaatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccccttgtgggatggagctgtcgaaggtgggatcggtgattaggactaagtcgtaacaaggtagccgtaccggaaggtgcggctggatcacctcctttctaagga

SEQ ID NO: 3965 - DNA, 1527 bp, Frigoribacterium sp. PhB118
  ref <308>: DATABASE ACCESSION NUMBER: NCBI ACCESSION: NZ_RKID01000011.1
  ref <309>: DATABASE ENTRY DATE: 2019-04-01
  ref <313>: RELEVANT RESIDUES IN SEQ ID NO: (1)..(1527)
tttacggagagtttgatcctggctcaggacgaacgctggcggcgtgcttaacacatgcaagtcgaacgatgaactggagcttgctccagggattagtggcgaacgggtgagtaacacgtgagtaacctgcccttgactctgggataagcgctagaaatggcgtctaataccggatacgagcttcagccgcatggctaggagttggaaagaattttggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtgggggccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtccagagatggtcgccccgcaaggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaacccttgtggatggagctgtcgaaggtgggatcggtgattaggactaagtcgtaacaaggtagccgtaccggaaggtgcggctggatcacctcctttctaagga

SEQ ID NO: 3966 - DNA, 1529 bp, Frigoribacterium sp. PhB160
  ref <308>: DATABASE ACCESSION NUMBER: NCBI ACCESSION: NZ_RKIE01000004.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacgatgaactccagcttgctggggggattagtggcgaacgggtgagtaacacgtgagtaacctgcccttgactctgggataagcgctggaaacggcgtctaataccggatacgagcttcagccgcatggctaggagttggaaagaattttggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacggccagagatggtcgccccgcaaggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccccttgtgggatggagctgtcgaaggtgggatcggtgattaggactaagtcgtaacaaggtagccgtaccggaaggtgcggctggatcacctcctttctaagga

SEQ ID NO: 3967 - DNA, 1340 bp, Frigoribacterium sp. PhB24
  ref <308>: DATABASE ACCESSION NUMBER: NCBI ACCESSION: NZ_RKIC01000006.1
  ref <309>: DATABASE ENTRY DATE: 2019-04-01
  ref <313>: RELEVANT RESIDUES IN SEQ ID NO: (1)..(1340)
cgcatggctaggagttggaaagaattttggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtgggggccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtccagagatggtcgccccgcaaggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaacccttgtggatggagctgtcgaaggtgggatcggtgattaggactaagtcgtaacaaggtagccgtaccggaaggtgcggctggatcacctcctttctaagga

SEQ ID NO: 3968 - DNA, 1528 bp, Frondihabitans australicus
  ref <308>: DATABASE ACCESSION NUMBER: NCBI ACCESSION: NZ_RBKS01000001.1
  ref <309>: DATABASE ENTRY DATE: 2019-04-01
  ref <313>: RELEVANT RESIDUES IN SEQ ID NO: (1)..(1528)
tttacggagagtttgatcctggctcaggacgaacgctggcggcgtgcttaacacatgcaagtcgaacgatgaacaccagcttgctggtgggattagtggcgaacgggtgagtaacacgtgagtaacctgcccttgactctgggataagcgttggaaacgacgtctaataccggataggactcctggccgcatggtctgggggtggaaagattttttggtcaaggatggactcgcggcctatcaggttgttggtgaggtaatggctcaccaagccgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtaggggccattccacggtttctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtccagagatggtcgccccgcaaggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccgatacaaagggctgcgataccgtaaggtggagcgaatcccaaaaagtcggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcccaacccttgtggagggagccgtcgaaggtgggatcggtgattaggactaagtcgtaacaaggtagccgtaccggaaggtgcggctggatcacctcctttctaagga

SEQ ID NO: 3969 - DNA, 1533 bp, Frondihabitans sp. 762G35
  ref <308>: DATABASE ACCESSION NUMBER: NCBI ACCESSION: NZ_CP014619.1
  ref <309>: DATABASE ENTRY DATE: 2019-04-01
  ref <313>: RELEVANT RESIDUES IN SEQ ID NO: (1)..(1533)
tttacggagagtttgatcctggctcaggacgaacgctggcggcgtgcttaacacatgcaagtcgaacgatgatccccagcttgctggggggattagtggcgaacgggtgagtaacacgtgagtaacctgcccttgactctgggataagcgttggaaacgacgtctaataccggatatgactcctggccgcatggtctgggggtggaaagattttttggtcaaggatggactcgcggcctatcaggtagttggtgaggtaatggctcaccaagccgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagtagggaagaagggagcttgctcttgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcaaatctctgggccgtaactgacgctgaggagcgaaagcatggggagcgaacaggattagataccctggtagtccatgccgtaaacgttgggaactagatgtaggggccattccacggtttctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtccagagatggtcgccccgcaaggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccgatacaaagggctgcaataccgtaaggtggagcgaatcccaaaaagtcggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcccaaccttttggagggagctgtcgaaggtgggatcggtgattaggactaagtcgtaacaaggtagccgtaccggaaggtgcggctggatcacctcctttctaagga

SEQ ID NO: 3970 - DNA, 1533 bp, Frondihabitans sp. PhB153
  ref <308>: DATABASE ACCESSION NUMBER: NCBI ACCESSION: NZ_RKQM01000008.1
  ref <309>: DATABASE ENTRY DATE: 2019-04-01
  ref <313>: RELEVANT RESIDUES IN SEQ ID NO: (1)..(1533)
tttacggagagtttgatcctggctcaggacgaacgctggcggcgtgcttaacacatgcaagtcgaacgatgaaggggagcttgcttcctggattagtggcgaacgggtgagtaacacgtgagtaacctgcccttgactctgggataagcgttggaaacgacgtctaataccggatatgacctgtgacggcatcgtctgcaggtggaaagaattttggtcaaggatggactcgcggcctatcaggtagttggtgaggtaacggctcaccaagccgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagttgggaagaagggagcttgctcttgacggtaccagcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagcatggggagcgaacaggattagataccctggtagtccatgccgtaaacgttgggaactagatgtaggggccattccacggtttctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtccagagatggtcgccccgcaaggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccgatacaaagggctgcaataccgcgaggtggagcgaatcccaaaaagtcggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcccaacccttgtggagggagctgtcgaaggtgggatcggtgattaggactaagtcgtaacaaggtagccgtaccggaaggtgcggctggatcacctcctttctaagga

SEQ ID NO: 3971 - DNA, 1533 bp, Frondihabitans sp. PhB161; identical to SEQ ID NO: 3970
  ref <308>: DATABASE ACCESSION NUMBER: NCBI ACCESSION: NZ_RKQW01000007.1
  ref <309>: DATABASE ENTRY DATE: 2019-04-01
  ref <313>: RELEVANT RESIDUES IN SEQ ID NO: (1)..(1533)

SEQ ID NO: 3972 - DNA, 1533 bp, Frondihabitans sp. PhB188
  ref <308>: DATABASE ACCESSION NUMBER: NCBI ACCESSION: NZ_RJUO01000008.1
  ref <309>: DATABASE ENTRY DATE: 2019-04-01
  ref <313>: RELEVANT RESIDUES IN SEQ ID NO: (1)..(1533)
tttacggagagtttgatcctggctcaggacgaacgctggcggcgtgcttaacacatgcaagtcgaacgatgaacaggagcttgctcctgggattagtggcgaacgggtgagtaacacgtgagtaacctgcccttgactctgggataagcgttggaaacgacgtctaataccggatatgagctgcggccgcatggtctgcagttggaaagaattttggtcaaggatggactcgcggcctatcaggtagttggtgaggtaatggctcaccaagcctacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagttgggaagaagggagcttgctcttgacggtaccagcagaaaaagcaccggctaactacgtgccagcagccgcggtaatacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagcatggggagcgaacaggattagataccctggtagtccatgccgtaaacgttgggaactagatgtaggggccattccacggtttctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtccagagatggtcgccccgcaaggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccgatacaaagggctgcaataccgcgaggtggagcgaatcccaaaaagtcggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcccaacccttgtggagggagctgtcgaaggtgggatcggtgattaggactaagtcgtaacaaggtagccgtaccggaaggtgcggctggatcacctcctttctaagga

SEQ ID NO: 3973 - DNA, 1559 bp, Fructobacillus durionis
  ref <308>: DATABASE ACCESSION NUMBER: NCBI ACCESSION: NZ_FOLI01000015.1
  ref <309>: DATABASE ENTRY DATE: 2019-04-01
  ref <313>: RELEVANT RESIDUES IN SEQ ID NO: (1)..(1559)
tttaacatgagagtttgatcctggctcaggatgaacgctggcggcgtgcctaatacatgcaagtcgtacgaacagcggaaagtgcttgcactttccaagtaagtggcgaacgggtgagtaacacgtgaataacctgcctcaaagtctgggataaccactggaaacagtgactaataccggataaaacccagtagcacatgctacaaggttaaaagctgcgtttgcagcgctttaagatggattcgcggtgcattagttagttggtgaggtaaaggctcaccaagacgatgatgcatagccgagttgagagactgaccggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaacgggttcatgaggaaatgcatgagcagtgacggtaccataccagaaagggacggctaaatacgtgccagcagccgcggtaatacgtatgtcccgagcgttatccggatttattgggcgtaaagcgagcgcagacggttcgataagtctgaagtgaaagcccacagctcaactgtggaatggctttggaaactgtcgaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatggatactagttgttagagggtttccgccctttagtgacgaagcaaacgcattaagtatcccgcctggggagtacgaccgcaaggttgaaactcaaaggaattgacggggacccgcacaagcggtggagcatgtggtttaattcgaagcaacgcgaagaaccttaccaggtcttgacatcctttgaaggtctaagagattaggctgtcttcttcggaagcaaagtgacaggtggtgcatggccgtcgtcagctcgtgtcgtgagatgttgggttaagtcccgcaacgagcgcaacccttatgtttagttgccagcattcagttgggcactctagacagactgccggtgacaaaccggaggaaggcggggacgacgtcaggtcatcatgccccttatgacctgggctacacacgtgctacaatggcgtatacaacgagcagcgaacctgtgagggtaagcgaatctcttaaagtacgtctcagttcggattgtagtctgcaactcgactacatgaagtcggaatcgctagtaatcgcggatcagcatgccgcggtgaatacgttcccgggtcttgtacacaccgcccgtcacaccatgggagttggtaatgcccaaagccggtggcctaaccttcggggaggagccgtctaaggcaggactgatgactggggtgaagtcgtaacaaggtagccgtaggagaacctgcggctggatcacctcctttctaagga

SEQ ID NO: 3974 - DNA, 1559 bp, Fructobacillus fructosus
  ref <308>: DATABASE ACCESSION NUMBER: NCBI ACCESSION: NZ_JQBH01000021.1
  ref <309>: DATABASE ENTRY DATE: 2019-04-01
  ref <313>: RELEVANT RESIDUES IN SEQ ID NO: (1)..(1559)
tttaacatgagagtttgatcctggctcaggatgaacgctggcggcgtgcctaatacatgcaagtcgtacgaacagcggaaagtgcttgcactttccaagtaagtggcgaacgggtgagtaacacgtgaataacctacctcaaagtctgggataaccattggaaacagtgactaataccggataaaacccaagtgcacatgcactaaggttaaaagctgcgtttgcagcgctttaagatggattcgcggtgcattagttagttggtgaggtaaaggctcaccaagacgatgatgcatagccgagttgagagactgaccggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaacgggtttaagaggaaatgcttaaacagtgacggtaccataccagaaagggacggctaaatacgtgccagcagccgcggtaatacgtatgtcccgagcgttatccggatttattgggcgtaaagcgagcgcagacggttgcttaagtctgaagtgaaagcccacagctcaactgtggaatggctttggaaactgggcaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatggatactagttgttagagggtttccgccctttagtgacgaagcaaacgcattaagtatcccgcctggggagtacgaccgcaaggttgaaactcaaaggaattgacggggacccgcacaagcggtggagcatgtggtttaattcgaagcaacgcgaagaaccttaccaggtcttgacatcctttgaaggtactagagatagtgctgtcttcttcggaagcaaagtgacaggtggtgcatggccgtcgtcagctcgtgtcgtgagatgttgggttaagtcccgcaacgagcgcaacccttatgtttagttgccagcattcagttgggcactctagacagactgccggtgacaaaccggaggaaggcggggacgacgtcaggtcatcatgccccttatgacctgggctacacacgtgctacaatggcgtatacaacgagcagcaaacctgtgaaggtaagcgaatctcttaaagtacgtctcagttcggattgtagtctgcaactcgactacatgaagtcggaatcgctagtaatcgcggatcagcatgccgcggtgaatacgttcccgggtcttgtacacaccgcccgtcacaccatgggagttggtaatgcccaaagccggtggcctaaccttcggggaggagccgtctaaggcaggactgatgactggggtgaagtcgtaacaaggtagccgtaggagaacctgcggctggatcacctcctttctaagga

SEQ ID NO: 3975 - DNA, 1470 bp, Fructobacillus pseudoficulneus
  ref <308>: DATABASE ACCESSION NUMBER: NCBI ACCESSION: NZ_FNWS01000015.1
  ref <309>: DATABASE ENTRY DATE: 2019-04-01
  ref <313>: RELEVANT RESIDUES IN SEQ ID NO: (1)..(1470)
tttaacatgagagtttgatcctggctcaggatgaacgctggcggcgtgcctaatacatgcaagtcgaacgcgcagcgaagagtgcttgcactcttcaagcgagtggcgaacgggtgagtaacacgtgaataacctaccgaaaagcaggggataacatttggaaacagatgctaataccgtataaaacgtgctgtcgcatgacaaaacgttaaaaggtccgtttggaccactttttgatggattcgcggtgcattagttagttggtggggtaaaggctcaccaagacgatgatgcatagccgagttgagagactgaccggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaacggtaagggtaggaaatgatctttacatgacggtaccataccagaaagggacggctaaatacgtgccagcagccgcggtaatacgtatgtcccgagcgttatccggatttattgggcgtaaagcgagcgcagacggtttgataagtctgaagtgaaagcccacagctcaactgtggaagtgctttggaaactgtcaaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatgaacactaggtgttagggggtttccgccccttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaaggtacaagagattgtgctgttttcttcggaaacaaagtgacaggtggtgcatggccgtcgtcagctcgtgtcgtgagatgttgggttaagtcccgcaacgagcgcaacccttatgtttagttgccagcatttagttgggcactctagacagactgccggtgacaaaccggaggaaggcggggacgacgtcaggtcatcatgccccttatgacctgggctacacacgtgctacaatggcgtatacaacgagcagcgaactcgcgagggtaagcgaatctcttaaagtacgtctcagttcggattgtagtctgcaactcgactacatgaagtcggaatcgctagtaatcgcggatcagcatgccgcggtgaatacgttcccgggtcttgtacacaccgcccgtcacaccatgggagtttgtaatgcccaaagccggtggcctaaccttctgggagga

SEQ ID NO: 3976 - DNA, 1560 bp, Fructobacillus sp. EFB-N1
  ref <308>: DATABASE ACCESSION NUMBER: NCBI ACCESSION: NZ_LDUY01000062.1
  ref <309>: DATABASE ENTRY DATE: 2019-04-01
  ref <313>: RELEVANT RESIDUES IN SEQ ID NO: (1)..(1560)
tttaacatgagagtttgatcctggctcaggatgaacgctggcggcgtgcctaatacatgcaagtcgaacgcgcagcgaagagtgcttgcactcttcaagcgagtggcgaacgggtgagtaacacgtgaataacctaccgaaaagcaggggataacatttggaaacagatgctaataccgtataaaacgtgctgtcgcatgacaaaacgttaaaaggtccgtttggaccactttttgatggattcgcggtgcattagttagttggtggggtaaaggcccaccaagacgatgatgcatagccgagttgagagactgaccggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacggtaagggtaggaaatgacctttacatgacggtaccataccagaaagggacggctaaatacgtgccagcagccgcggtaatacgtatgtcccgagcgttatccggatttattgggcgtaaagcgagcgcagacggttcgataagtctgaagtgaaagcccacagctcaactgtggaagtgctttggaaactgtcgaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatgaacactaggtgttagagggtttccgccctttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaaggtactagagatagtgctgttttcttcggaaacaaagtgacaggtggtgcatggccgtcgtcagctcgtgtcgtgagatgttgggttaagtcccgcaacgagcgcaacccttatgtttagttgccagcattcagttgggcactctagacagactgccggtgacaaaccggaggaaggcggggacgacgtcaggtcatcatgccccttatgacctgggctacacacgtgctacaatggcgtatacaacgagcagcgaactcgcgagggtaagcgaatctcttaaagtacgtctcagttcggattgtagtctgcaactcgactacatgaagtcggaatcgctagtaatcgcggatcagcatgccgcggtgaatacgttcccgggtcttgtacacaccgcccgtcacaccatgggagtttgtaatgcccaaagccggtggcctaaccttttagggaggagccgtctaaggcaggacagatgactggggtgaagtcgtaacaaggtagccgtaggagaacctgcggctggatcacctcctttctaagga

SEQ ID NO: 3977 - DNA, 1558 bp, Fructobacillus tropaeoli
  ref <308>: DATABASE ACCESSION NUMBER: NCBI ACCESSION: NZ_DF968095.1
  ref <309>: DATABASE ENTRY DATE: 2019-04-01
  ref <313>: RELEVANT RESIDUES IN SEQ ID NO: (1)..(1558)
ttaacatgagagtttgatcctggctcaggatgaacgctggcggcgtgcctaatacatgcaagtcgaacgcgcagcgaagagtgcttgcactcttcaagcgagtggcgaacgggtgagtaacacgtgaataacctaccgaaaagcaggggataacatttggaaacagatgctaataccgtataaaacgtgctgtcgcatgacaaaacgttaaaaggtccgtttggaccactttttgatggattcgcggtgcattagttagttggtggggtaaaggcctaccaagacgatgatgcatagccgagttgagagactgaccggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacggtaagggtaggaaatgatctttacatgacggtaccataccagaaagggacggctaaatacgtgccagcagccgcggtaatacgtatgtcccgagcgttatccggatttattgggcgtaaagcgagcgcagacggttcgataagtctgaagtgaaagcccacagctcaactgtggaagtgctttggaaactgtcgaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatgaacactaggtgttagagggtttccgccctttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaaggtactagagatagtgctgttttcttcggaaacaaagtgacaggtggtgcatggccgtcgtcagctcgtgtcgtgagatgttgggttaagtcccgcaacgagcgcaacccttatgtttagttgccagcattcagttgggcactctagacagactgccggtgacaaaccggaggaaggcggggacgacgtcaggtcatcatgccccttatgacctgggctacacacgtgctacaatggcgtatacaacgagcagcgaactcgcgagggtaagcgaatctcttaaagtacgtctcagttcggattgtagtctgcaactcgactacatgaagtcggaatcgctagtaatcgcggatcagcatgccgcggtgaatacgttcccgggtcttgtacacaccgcccgtcacaccatgggagtttgtaatgcccaaagccggtggcctaaccttttggaaggagccgtctaaggcaggacagatgactggggtgaagtcgtaacaaggtagccgtaggagaacctgcggctggatcacctcctttctaagga

SEQ ID NO: 3978 - DNA, 1492 bp, Fulvimarina manganoxydans
  ref <308>: DATABASE ACCESSION NUMBER: NCBI ACCESSION: NZ_FWXR01000045.1
  ref <309>: DATABASE ENTRY DATE: 2019-04-01
  ref <313>: RELEVANT RESIDUES IN SEQ ID NO: (1)..(1492)
atcgaacctgagagtttgatcctggctcagaacgaacgctggcggcaggcttaacacatgcaagtcgagcgccccgcaaggggagcggcagacgggtgagtaacgcgtgggaacgtacccttctctacgggatagctccgggaaactggaattaataccgtatacgtccgagaggagaaagatttatcggagaaggatcggcccgcgttggattagctagttggtggggtaaaggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgacggtcttaggattgtaaagctctttcaccggagacgataatgacggtatccggagaagaagccccggctaacttcgtgccagcagccgcggtaatacgaagggggctagcgttgttcggaattactgggcgtaaagcgcacgtaggcggaccaatcagtcaggggtgaaatcccggggctcaaccccggaacggcctttgatactgttggtctagagtgtgagagaggtgagtggaattgcgagtgtagaggtgaaattcgtagatattcgcaggaacaccagtggcgaaggcggctcactggctcacaactgacgctgaggtgcgaaagcgtggggagcaaacaggattagataccctggtagtccacgccgtaaacgatggaagctagccgtcgggttgtttacagctcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatgccacgacggttcccggagacgggttcctccctttgggcgtggacacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggcggtgacaatgggcagcaagccagcgatggtgagctaatctccaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggtttgacccgaagatggtgcgctaacccgataagggaggcagccagccacggtcaggtcagcgactggggtgaagtcgtaacaaggtagccgtaggggaacctgcggctggatcacctcctttctaagg

SEQ ID NO: 3979 - DNA, 1498 bp, Fulvimarina pelagi
  ref <308>: DATABASE ACCESSION NUMBER: NCBI ACCESSION: NZ_BBWO01000016.1
  ref <309>: DATABASE ENTRY DATE: 2019-04-01
  ref <313>: RELEVANT RESIDUES IN SEQ ID NO: (1)..(1498)
cttttgatcgaacctgagagtttgatcctggctcagaacgaacgctggcggcaggcttaacacatgcaagtcgagcgcatccttcggggtgagcggcagacgggtgagtaacgcgtgggaatctacccatccctacgggatagctccgggaaactggaattaagaccgtatacgtccgtaaggagaaagatttatcggggatggatgagcccgcgtaggattagctagttggtgcggtaacggcgtaccaaggcgacgatccttagctggtctaagaggatgatcagccacactgggactgagacacggcccagactcctacgggaggcagcagtggggaatattggacaatgggcgcaagcctgatccagccatgccgcgtgagtgatgacggtcttaggattgtaaagctctttcagtggggacgataatgacggtacccacagaagaagccccggctaacttcgtgccagcagccgcggtaatacgaagggggctagcgttgttcggaattactgggcgtaaagcgcacgtaggcggatcagccagtcaggggtgaaatcccagggctcaaccctggaacggcctctgatactgttgatctggagtgtgagagaggtgagtggaattgcgagtgtagaggtgaaattcgtagatattcgcaggaacaccagtggcgaaggcggctcactggctcacaactgacgctgaggtgcgaaagcgtggggagcaaacaggattagataccctggtagtccacgccgtaaacgatggaagctagccgtcggcgggtttactcgtcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatcctctgacggtcaccggagacggtttcctcccttcggggcagagtgacaggtgctgcatggctgtcgtcagctcgtgtcgtgagatgttgggttaagtcccgcaacgagcgcaaccctcgcccctagttgccagcattaggttgggcactctagggggactgccggtgataagccgagaggaaggtggggatgacgtcaagtcctcatggcccttacgggctgggctacacacgtgctacaatggcggtgacagtgggcagcgaggcagcgatgccgagctaatctccaaaagccgtctcagttcggattgcactctgcaactcgggtgcatgaagttggaatcgctagtaatcgtggatcagcatgccacggtgaatacgttcccgggccttgtacacaccgcccgtcacaccatgggagttgggtctacccgaagatggtgcgctaacctcttggaggcagccagccacggtaggctcagcgactggggtgaagtcgtaacaaggtagccgtaggggaacctgcggctggatcacctcctttctaagg

SEQ ID NO: 3980 - DNA, 1487 bp, Fulvimarina sp. 85
  ref <308>: DATABASE ACCESSION NUMBER: NCBI ACCESSION: NZ_QURL01000011.1
  ref <309>: DATABASE ENTRY DATE: 2019-04-01
  ref <313>: RELEVANT RESIDUES IN SEQ ID NO: (1)..(1487)
aacctgagagtttgatcctggctcagaacgaacgctggcggcaggcttaacacatgcaagtcgaacgctctcttcggagggagtggcagacgggtgagtaacgcgtgggaatctacccatctctacggaatagctccgggaaactggaattaagaccgtatacgtccgtaaggagaaagatttatcggagatggatgagcccgcgtaggattagctagttggtggggtaatggcccaccaaggcgacgatccttagctggtctaagaggatgatcagccacactgggactgagacacggcccagactcctacgggaggcagcagtggggaatattggacaatgggcgcaagcctgatccagccatgccgcgtgagtgatgacggtcttaggattgtaaagctctttcagtggggacgataatgacggtacccacagaagaagccccggctaacttcgtgccagcagccgcggtaatacgaagggggctagcgttgttcggaattactgggcgtaaagcgcacgtaggcggattctcaagtcaggggtgaaatcccagggctcaaccctggaacggcctctgatactgttgatctagagtgtgagagaggtgagtggaattgcgagtgtagaggtgaaattcgtagatattcgcaggaacaccagtggcgaaggcggctcactggctcacaactgacgctgaggtgcgaaagcgtggggagcaaacaggattagataccctggtagtccacgccgtaaacgatggaagctagccgtcgggttgtttacagctcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatcctctgacgccatttggagacgaatggttcccttcggggcagagtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggcggtgacagtgggcagcaagccagcgatggtgagctaatctccaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggtggtgcgctaacccgcaagggaggcagccaaccacggtagggtcagcgactggggtgaagtcgtaacaaggtagccgtaggggaacctgcggctggatcacctcctttcta

SEQ ID NO: 3981 - DNA, 1525 bp, Fulvivirga imtechensis
  ref <308>: DATABASE ACCESSION NUMBER: NCBI ACCESSION: NZ_AMZN01000157.1
  ref <309>: DATABASE ENTRY DATE: 2019-04-01
  ref <313>: RELEVANT RESIDUES IN SEQ ID NO: (1)..(1525)
ttacaatggagagtttgatcctggctcaggatgaacgctagcggcaggcctaatacatgcaagtcgaacggcagcacgatcttcggattggtggcgagtggcgcacgggtgcgtaacgcgtatgcaacctaccctcaacagggggatagcccggggaaacccggattaataccccatagtatattgatatcgcatgattgtcaatattaaagatttatcggttgaggatgggcatgcgtctgattagttagttggtagtgtaacggactaccaaggcaatgatcagtaggggttctgagaggatgatcccccacactggcactgagatacgggccagactcctacgggaggcagcagtagggaatattggtcaatgggcgagagcctgaaccagccatgccgcgtgcaggaagacggccttctgggttgtaaactgcttttatcagggaacaaaaagtccatgcgtggaaaattgcgtgtacctgaggaataagcaccggctaactccgtgccagcagccgcggtaatacggagggtgcaagcgttgtccggatttattgggtttaaagggtgcgtaggtggtcgattaagtcagtggtgaaagcccacagctcaactgtggaattgccattgatactggttgacttgagtatagacgaggtaggcggaatttatggtgtagcggtgaaatgcatagataccataaagaacaccgatagcgaaggcagcttactagactataactgacactgaggcacgaaagcgtggggagcgaacaggattagataccctggtagtccacgctgtaaacgatgctcactcgatgtatgcgatataccgtatgcgtccaagcgaaagcgttaagtgagccacctggggagtacgctcgcaagagtgaaactcaaaggaattgacgggggtccgcacaagcggtggagcatgtggtttaattcgatgatacgcgaggaaccttacctgggctagaatgtgagcgcaatccccagagatggggagttcttcggacgtgaaacaaggtgctgcatggctgtcgtcagctcgtgccgtgaggtgttgggttaagtcccgcaacgagcgcaacccctattgttagttgccatcaggtaaagctggggactctaacaagactgcctgcgcaagcagagaggaaggaggggatgacgtcaagtcatcatggcccttacgcccagggctacacacgtgctacaatggcgtatacagagggtcgctacctggtaacaggatgccaatctcaaaaagtacgtctcagttcggatcggggtctgcaactcgaccccgtgaagtcggaatcgctagtaatcgcgcatcagcaatggcgcggtgaatacgttcccggaccttgtacacaccgcccgtcaagccatggaagttgggaggacctgaagacagttgtcgcgagacgctgtttagggttataccagtaactagggctaagtcgtaacaaggtagccgtaccggaaggtgtggctggaacacctcctttcta

SEQ ID NO: 3982 - DNA, 1540 bp, Fusibacter sp. 3D3
  ref <308>: DATABASE ACCESSION NUMBER: NCBI ACCESSION: NZ_BDHH01000001.1
  ref <309>: DATABASE ENTRY DATE: 2019-04-01
  ref <313>: RELEVANT RESIDUES IN SEQ ID NO: (1)..(1540)
ttataattaagagtttgatcctggctcaggatgaacgctggcggcgtgcctaacacatgcaagtcgagcgagaattaagggagtggagacttcggtcaaagcaagcttaaggaaagcggcggacgggtgagtaacgcgtgggtaacctgcctcatacaaagggatagccactggaaacggtgattaataccctataagactacgagatcgcatgatctagtagccaaagatttatcggtatgagatggacccgcgtctgattagctagttggtgaggtaatggctcaccaaggcgacgatcagtagccgacctgagagggtgatcggccacactggaactgagacacggtccagactcctacgggaggcagcagtggggaatattgcacaatgggcgcaagcctgatgcagcaacgccgtgtgagtgatgaaggtcttcggattgtaaaactctgtcctaggggaagaaaaaaatgacggtaccctaggaggaagccccggctaactacgtgccagcagccgcggtaatacgtagggggcaagcgttatccggaatcactgggcgtaaagggtgcgtaggcggcctaacaagtcagaggtgaaaggcattggctcaaccaatgtaagcctttgaaactgttgggcttgagtgcaggagaggtaagtggaattcctagtgtagaggtgaaattcgtagatattaggaggaacaccagtggcgaaggcgacttactggactgtaactgacgctgaggcacgaaagcgtggggagcgaacaggattagataccctggtagtccacgccgtaaacgatgaatactaggtgtcgggggtcaaacctcggtgccgcagctaacgcaataagtattccgcctggggagtacgcacgcaagtgtgaaactcaaaggaattgacggggacccgcacaagcagcggagcatgtggtttaattcgaagcaacgcgaagaaccttaccaggtcttgacatcctcctgaatacaccctagccggtgtaggccttcgggacaggagagacaggtggtgcatggttgtcgtcagctcgtgtcgtgagatgttgggttaagtcccgcaacgagcgcaacccttatgtttagttgttaacaggtcaagctgaaccctctagacagactgccgaggataactcggaggaaggcggggatgacgtcaaatcatcatgccccttatgatctgggctacacacgtgctacaatggctggtacaacgggcagcgaaagagcgatctggagcgaatcctaaaaagccagtcccagttcggattgcaggctgaaactcgcctacatgaagttggagttgctagtaatcgcggatcagaatgccgcggtgaatgcgttcccgggtcttgtacacaccgcccgtcacaccatggaagttgggggcgcccgaagccagtggtccaacccttttagggaggaagctgtcgaaggtgaaatcaatgactggggtgaagtcgtaacaaggtagccgtatcggaaggtgcggctggatcacctcctttcta

SEQ ID NO: 3983 - DNA, 1541 bp, Fusicatenibacter saccharivorans
  ref <308>: DATABASE ACCESSION NUMBER: NCBI ACCESSION: NZ_CZAL01000009.1
  ref <309>: DATABASE ENTRY DATE: 2019-04-01
  ref <313>: RELEVANT RESIDUES IN SEQ ID NO: (1)..(1541)
ttttatcagagagtttgatcctggctcaggatgaacgctggcggcgtgcttaacacatgcaagtcgagcgaagcagttaagaagattcttcggatgattcttaactgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaaccttttaggagggagctgccgaaggcgggactgataactggggtgaagtcgtaacaaggtagccgtatcggaaggtgcggctggatcacctcctttctaaggaa

SEQ ID NO: 3984 - DNA, 1531 bp, Fusobacterium canifelinum
  ref <308>: DATABASE ACCESSION NUMBER: NCBI ACCESSION: NZ_RQYY01000040.1
  ref <309>: DATABASE ENTRY DATE: 2019-04-01
  ref <313>: RELEVANT RESIDUES IN SEQ ID NO: (1)..(1531)
aaaaagattgaacgaagagtttgatcctggctcaggatgaacgctgacagaatgcttaacacatgcaagtctacttgaatttgggttttttaacttcgatttgggtggcggacgggtgagtaacgcgtaaagaacttgcctcacagctagggacaacatttggaaacgaatgctaatacctaatattatgattttagggcatcctagaattatgaaagctatatgcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcctttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagtacagagagtcgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgcaaggagggatgctccgagggtgtgattagcgattggggtgaagtcgtaacaaggtatccgtacgggaacgtgcggatggatcacctcctttcta

SEQ ID NO: 3985 - DNA, 1521 bp, Fusobacterium equinum
  ref <308>: DATABASE ACCESSION NUMBER: NCBI ACCESSION: NZ_KQ956581.1
  ref <309>: DATABASE ENTRY DATE: 2019-04-01
  ref <313>: RELEVANT RESIDUES IN SEQ ID NO: (1)..(1521)
aaaaatcgaacgaagagtttgatcctggctcaggatgaacgctgacagaatgcttaacacatgcaagtcgactcgagtcttcggacttgggtggcggacgggtgagtaacgcgtaaagaacttgcctcatagtctgggacaacatctggaaacggatgctaataccggatattatgctttcttcgcatggaggaagtatgaaagctatatgcgctatgagagagctttgcgtcccattagctagttggtgaggtaacggcccaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagtcgggaagaagcaagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggggctcaactccgtattgcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctacaaagagtgcagagatgcgcttgtgcttcttcggaagaatgtagtgacaggtggtgcatggctgtcgtcagctcgtgtcgtgagatgttgggttaagtcccgcaacgagcgcaacccctatcgtatgttaccagcctttagttggggactcatgcgatactgcctgcgacgagcaggaggaaggtggggatgacgtcaagtcatcatgccccttatacgctgggctacacacgtgctacaatgggtagtacagagagcggcgaacccgcgagggggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacaccacgagagttggttgcacctgaagtagcaggcctaaccgtaaggaaggatgctccgagggtgtggttagcgattggggtgaagtcgtaacaaggtatccgtacgggaacgtgcggatggatcacctcctttctaagga

SEQ ID NO: 3986 - DNA, 1521 bp, Fusobacterium gonidiaformans
  ref <308>: DATABASE ACCESSION NUMBER: NCBI ACCESSION: NZ_CP028106.1
  ref <309>: DATABASE ENTRY DATE: 2019-04-01
  ref <313>: RELEVANT RESIDUES IN SEQ ID NO: (1)..(1521)
aaaaatcgaacgaagagtttgatcctggctcaggatgaacgctgacagaatgcttaacacatgcaagtcgactcgagtcttcggacttgggtggcggacgggtgagtaacgcgtaaagaacttgcctcatagtctgggacaacatttggaaacggatgctaataccggatattatgctttcttcgcatggaggaagtatgaaagctatatgcgctatgagagagctttgcgtcccattagctagttggtgaggtaacggcccaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagtcgggaagaagcaagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggggctcaactccgtattgcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctacaaagagtgcagagatgcgcttgtgcttcttcggaagaatgtagtgacaggtggtgcatggctgtcgtcagctcgtgtcgtgagatgttgggttaagtcccgcaacgagcgcaacccctatcgtatgttaccagcctttagttggggactcatgcgatactgcctgcgacgagcaggaggaaggtggggatgacgtcaagtcatcatgccccttatacgctgggctacacacgtgctacaatgggtagtacagagagcggcgaacccgcgagggggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacaccacgagagttggttgcacctgaagtagcaggcctaaccgtaaggaaggatgctccgagggtgtggttagcgattggggtgaagtcgtaacaaggtatccgtacgggaacgtgcggatggatcacctcctttctaagga

SEQ ID NO: 3987 - DNA, 1552 bp, Fusobacterium hwasookii
  ref <308>: DATABASE ACCESSION NUMBER: NCBI ACCESSION: NZ_CP013331.1
  ref <309>: DATABASE ENTRY DATE: 2019-04-01
  ref <313>: RELEVANT RESIDUES IN SEQ ID NO: (1)..(1552)
aaacaaaatagcaagaatgagctattaaaaaagattgaacgaagagtttgatcctggctcaggatgaacgctgacagaatgcttaacacatgcaagtcaacttgaacttcggtttgggtggcggacgggtgaataacgcgtaaagaacttgcctcacagttagggacaacatttggaaacgaatgctaatacctgatattatgattttagggcatcctagaattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaagagtctgatccagcaattctgtgtgcatgatgaagtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttctaaggagaaa

SEQ ID NO: 3988 - DNA, 1546 bp, Fusobacterium massiliense
  ref <308>: DATABASE ACCESSION NUMBER: NCBI ACCESSION: NZ_LT608325.1
  ref <309>: DATABASE ENTRY DATE: 2019-04-01
  ref <313>: RELEVANT RESIDUES IN SEQ ID NO: (1)..(1546)
taaacaaaaaagcaaatgagctttaaaaaagattgaacgaagagtttgatcctggctcaggatgaacgctgacagaatgcttaacacatgcaagtctacttgaacttcggtttgggtggcggacgagtgagtaacgcgtaaagaacttgcctcacagtttgggacaacatttggaaacgaatgctaataccgaatattatgatcgaatggcatcatttgattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggaagaagaaagtgacggtaccaacagaagaagtgacggctaaatacgtgccagcagccgcggtaatacgtatgtcacaagcgttatccggatttattgggcgtaaagcgcgtctaggcggttaattaagtctgatgtgaaaatgcggagctcaactccgtattgcgttggaaactggttaactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgctgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgacgtagagatatgtcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaacctgcgagggggagctaatctcagaaaactattcttagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttctaagga

SEQ ID NO: 3989 - DNA, 1525 bp, Fusobacterium mortiferum
  ref <308>: DATABASE ACCESSION NUMBER: NCBI ACCESSION: NZ_QRHL01000058.1
  ref <309>: DATABASE ENTRY DATE: 2019-04-01
  ref <313>: RELEVANT RESIDUES IN SEQ ID NO: (1)..(1525)
ttatatagattgaacgaagagtttgatcctggctcaggatgaacgctgacagaatgcttaacacatgcaagtctacttgatccttcgggtgatggtggcggacgggtgagtaacgcgtaaagaacttgccctgcagtctgggacaacatttggaaacgaatgctaataccggatattatgtgagtttcgcatgaaattcatatgaaagctatatgcgctgcaggagagctttgcgtcctattagctagttggtgaggtaacggctcaccaaggcgatgataggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggacgaagtaagtgacggtaccaacagaagaagcgacggctaaatacgtgccagcagccgcggtaatacgtatgtcgcaagcgttatccggatttattgggcgtaaagcgcgtctaggcggtttggtaagtctgatgtgaaaatgcggggctcaactccgtattgcgttggaaactgccaaactagagtactggagaggtgggcggaactacaagtgtagaggtgaaattcgtagatatttgtaggaatgccgatggggaagccagcccactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctaagaaattagcagagatgcttttgtgccccttcgggggaacttagtgacaggtggtgcatggctgtcgtcagctcgtgtcgtgagatgttgggttaagtcccgcaacgagcgcaacccctttcgtatgttgccatcattaagttgggcactcatgcgatactgcctgcgatgagcaggaggaaggtggggatgacgtcaagtcatcatgccccttatacgctgggctacacacgtgctacaatgggtagtacagagagtcgcaaacctgcgagggggagctaatctcagaaaactattctcagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtagcaggcctaaccgcaaggagggatgctccgagggtgtgattagcgattggggtgaagtcgtaacaaggtatccgtacgggaacgtgcggatggatcacctcctttctaagga

SEQ ID NO: 3990 - DNA, 1521 bp, Fusobacterium necrophorum
  ref <308>: DATABASE ACCESSION NUMBER: NCBI ACCESSION: NZ_FMXX01000002.1
  ref <309>: DATABASE ENTRY DATE: 2019-04-01
  ref <313>: RELEVANT RESIDUES IN SEQ ID NO: (1)..(1521)
aaacatcgaacgaagagtttgatcctggctcaggatgaacgctgacagaatgcttaacacatgcaagtcgactcgagtcttcggacttgggtggcgcacgggtgagtaacgcgtaaagaacttgcctcttagtctgggacaacatctggaaacggatgctaataccggatattatggttttttcgcatggaggaatcatgaaagctagatgcgctaagagagagctttgcgtcccattagctagttggtgaggtaacggcccaccaaggcaatgatgggtagccggcctgagagggtgaacggccacaaggggactgagacacggcccttactcctacgggaggcagcagtggggaatattggacaatggaccacaagtctgatccagcaattctgtgtgcacgatgacgtttttcggaatgtaaagtgctttcagtcgggaagaagtcagtgacggtaccgacagaagaagcgacggctaaatacgtgccagcagccgcggtaatacgtatgtcgcaagcgttatccggatttattgggcgtaaagcgcgtctaggcggcaaggaaagtctgatgtgaaaatgcggagctcaactccgtatggcgttggaaactgccttactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgctgtaaacgatgattactaggtgttgggggtcaaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctacgaacggagcagagatgcgccggtgccctttcgggggaacgtagtgacaggtggtgcatggctgtcgtcagctcgtgtcgtgagatgttgggttaagtcccgcaacgagcgcaacccctatcgtatgttaccatccttcagttggggactcatgcgatactgcctgcgacgagcaggaggaaggtggggatgacgtcaagtcatcatgccccttatacgctgggctacacacgtgctacaatgggtagtacagagagcggcaaacccgcgagggggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacaccacgagagttggttgcacctgaagtagcaggcctaaccttagggaaggatgctccgagggtgtggttagcgattggggtgaagtcgtaacaaggtatccgtacgggaacgtgcggatggatcacctcctttctaagga

SEQ ID NO: 3991 - DNA, 1531 bp, Fusobacterium perfoetens
  ref <308>: DATABASE ACCESSION NUMBER: NCBI ACCESSION: NZ_JHXW01000023.1
  ref <309>: DATABASE ENTRY DATE: 2019-04-01
  ref <313>: RELEVANT RESIDUES IN SEQ ID NO: (1)..(1531)
tataaagttttaatgaagagtttgatcctggctcaggatgaacgctgacagaatgcttaacacatgcaagtctacttgaattcacttcggtgatagtaaggtggcggacgggtgagtaacacgtaaagaacttgccttgtagtctgggacaactattggaaacgatagctaataccggatattatgattttatcgcatgataagattatgaaagctatatgcgctacgagagagctttgcgtcccattagctagttggtgaggtaacggctcaccaaggcgacgatgggtagccggcctgagagggtgaacggccacaaggggactgagacacggcccttactcctacgggaggcagcagtggggaatattggacaatggaccaaaagtctgatccagcaattctgtgtgcacgatgacggtcttaggattgtaaagtgctttcaattgggaagaaacaaatgacggtaccaatagaagaagcgacggctaaatacgtgccagcagccgcggtaatacgtatgtcgcaagcgttatccggatttattgggcgtaaagcgcgtctaggtggtttggtaagtctgatgtgaaaatgcggggctcaactccgtattgcgttggaaactgcctaactagagtatcggagaggtgggcggaactacaagtgtagaggtgaaattcgtagatatttgtaggaatgccgatagagaagtcagctcactggacgaatactgacactgaagcgcgaaagcatggggagcaaacaggattagataccctggtagtccatgctgtaaacgatgattactaagcgtcgggggtcgaacctcggcactcaagctaacgcgataagtaatccgcctggggagtacgtacgcaagtatgaaactcaaaggaattgacggggacccgcacaagtggtggagcatgtggtttaattcgacgcaacgcgaggaaccttaccagcgtttgacatcctaggaatgagaaagagatttcttagtgctccttcgggagaacctagagacaggtggtgcatggctgtcgtcagctcgtgtcgtgagatgttgggttaagtcccgcaacgagcgcaacccctattgtatgttgccatcattaagttgggcactcatgcgatactgcctgcgatgagcaggaggaaggtggggatgacgtcaagtcatcatgccccttatacgctgggctacacacgtgctacaatgggcagtacagagagaagcaatttcgcgagaaggagcaaatctcagaaagctgttcgtagttcggattgtactctgcaactcgagtacatgaagttggaatcactagtaatcgcaaatcagctatgttgcggtgaatacgttctcgggtcttgtacacaccgcccgtcacaccacgagagttgattgcacctgaagtagcaggcctaaccgtaaggatggatgctccgagggtgtggttagcgattggggtgaagtcgtaacaaggtatccgtacgggaacgtgcggatggatcacctcctttctaagga

SEQ ID NO: 3992 - DNA, 1544 bp, Fusobacterium periodonticum
  ref <308>: DATABASE ACCESSION NUMBER: NCBI ACCESSION: NZ_CP028108.1
  ref <309>: DATABASE ENTRY DATE: 2019-04-01
  ref <313>: RELEVANT RESIDUES IN SEQ ID NO: (1)..(1544)
taaataaaatagcaaaattgagctattaaaaagattgaacgaagagtttgatcctggctcaggatgaacgctgacagaatgcttaacacatgcaagtctacttgaacttcggtttgggtggcggacgggtgagtaacgcgtaaagaacttgcctcacagttagggacaacatttggaaacgaatgctaatacctgatattatgattttagggcatcctaagattatgaaagctatatgcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaaaagtctgatccagcaattctgtgtgcacgatgacgtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcacttcggtgaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagtacagagagtcgcaaagccgcgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgcaaggagggatgctccgagggtgtgattagcgattggggtgaagtcgtaacaaggtatccgtacgggaacgtgcggatggatcacctcctttcta

SEQ ID NO: 3993 - DNA, 1311 bp, Fusobacterium russii
  ref <308>: DATABASE ACCESSION NUMBER: NCBI ACCESSION: NZ_KB906944.1
  ref <309>: DATABASE ENTRY DATE: 2019-04-01
  ref <313>: RELEVANT RESIDUES IN SEQ ID NO: (1)..(1311)
gcgctgtgagagagctttgcgtcccattagctagttggagaggtaacggctcaccaaggcgatgatgggtagccggcctgagagggtgaacggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaagaaagtgacggtaccaacagaagaagcgacggctaaatacgtgccagcagccgcggtaatacgtatgtcgcaagcgttatccggatttattgggcgtaaagcgcgtctaggcggctagataagtctgatgtgaaaatgcggggctcaactccgtattgcgttggaaactgtatagctagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctactaagggctcagagatgagcttgtgctccttcgggagaaagtagagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagaacagagagtggcgaagctgtgaagtggagcaaatctcagaaaactattcttagttcggattgtactctgcaactcgagtacatgaagttggaatcgctagtaatcgcaaatcagcaatgttgcggtgaatacgttctcgggtcttgtacacaccgcccgtcacaccacgagagttggttgcacctgaagtaacaggcctaaccgaaaggagggatgttccgagggtgtgattagcgattggggtgaagtcgtaacaaggtatccgtacgggaacgtgcggatggatcacctcctttctaagga

SEQ ID NO: 3994 - DNA, 1522 bp, Fusobacterium sp.
  ref <308>: DATABASE ACCESSION NUMBER: NCBI ACCESSION: NZ_FAUS01000008.1
  ref <309>: DATABASE ENTRY DATE: 2019-04-01
  ref <313>: RELEVANT RESIDUES IN SEQ ID NO: (1)..(1522)
aatagattgaacgaagagtttgatcctggctcaggatgaacgctgacagaatgcttaacacatgcaagtctacttgatccttcgggtgatggtggcggacgggtgagtaacgcgtaaagaacttgccctgcagttcgggacaacatctggaaacggatgctaataccgggtattatactttagtcgcatgacttttgtatgaaagctatatgcgctgcaggagagctttgcgtcctattagcttgttggtgaggtaacggctcaccaaggcgatgataggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggacgaagaacgtgacggtaccaacagaagaagcgacggctaaatacgtgccagcagccgcggtaatacgtatgtcgcaagcgttatccggatttattgggcgtaaagcgcgtctaggtggtttggtaagtctgatgtgaaaatgcggggctcaactccgtattgcgttggaaactgtcaaactagagtactggagaggtgggcggaactacaagtgtagaggtgaaattcgtagatatttgtaggaatgccgatggagaagtcagcccactggacagatactgacgctgaagcgcgaaagcgtgggtagcaaacaggattagataccctggtagtccacgctgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcctaagaagttagcagagatgctgatgtgccccttcgggggaacttagtgacaggtggtgcatggctgtcgtcagctcgtgtcgtgagatgttgggttaagtcccgcaacgagcgcaacccctttcgtatgttgccatcattaagttgggcactcatgcgatactgcctgcgacgagcaggaggaaggtggggatgacgtcaagtcatcatgccccttatacgctgggctacacacgtgctacaatgggtagtacagagagtggcgaacctgtgaagggaagctaatctcagaaaactattctcagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttctaagga

SEQ ID NO: 3995 - DNA, 1559 bp, Fusobacterium sp. CM1
  ref <308>: DATABASE ACCESSION NUMBER: NCBI ACCESSION: NZ_JANB01000140.1
  ref <309>: DATABASE ENTRY DATE: 2019-04-01
  ref <313>: RELEVANT RESIDUES IN SEQ ID NO: (1)..(1559)
aaataatagcaagaatgagctataagaaaagattgaacgaagagtttgatcctggctcaggatgaacgctgacagaatgcttaacacatgcaagtcaacttgaatttgggtttttaacttagatttgggtggcggacgggtgagtaacgcgtaaagaacttgcctcacagctagggacaacatttagaaatgaatgctaatacctgatattatgattttaaggcatcttagaattatgaaagctatatgcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaagaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgctgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagccgtgaggtgaagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttctaagga

SEQ ID NO: 3996 - DNA, 1315 bp, Fusobacterium sp. CM21
  ref <308>: DATABASE ACCESSION NUMBER: NCBI ACCESSION: NZ_AZYU01000199.1
  ref <309>: DATABASE ENTRY DATE: 2019-04-01
  ref <313>: RELEVANT RESIDUES IN SEQ ID NO: (1)..(1315)
gcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaacaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagtcgcaaagctgtgaagtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttctaaggagaaa

SEQ ID NO: 3997 - DNA, 1560 bp, Fusobacterium sp. CM22
  ref <308>: DATABASE ACCESSION NUMBER: NCBI ACCESSION: NZ_JAQC01000060.1
  ref <309>: DATABASE ENTRY DATE: 2019-04-01
  ref <313>: RELEVANT RESIDUES IN SEQ ID NO: (1)..(1560)
aaacaaaatagcagaatgagctattaaaaagattgaacgaagagtttgatcctggctcaggatgaacgctgacagaatgcttaacacatgcaagtctacttgaatttgggttttttaacttcgatttgggtggcggacgggtgagtaacgcgtaaagaacttgcctcacagatagggacaacatttggaaacgaatgctaatacctgatattatgattttagggcatcctaggattatgaaagctatatgcactgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgtgaggtgaagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttctaagga

SEQ ID NO: 3998 - DNA, 1329 bp, Fusobacterium sp. HMSC064B11
  ref <308>: DATABASE ACCESSION NUMBER: NCBI ACCESSION: NZ_KV821682.1
  ref <309>: DATABASE ENTRY DATE: 2019-04-01
  ref <313>: RELEVANT RESIDUES IN SEQ ID NO: (1)..(1329)
gattatgaaagctatatgcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactgggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttctaagga

SEQ ID NO: 3999 - DNA, 1563 bp, Fusobacterium sp. HMSC064B12
  ref <308>: DATABASE ACCESSION NUMBER: NCBI ACCESSION: NZ_KV803417.1
  ref <309>: DATABASE ENTRY DATE: 2019-04-01
  ref <313>: RELEVANT RESIDUES IN SEQ ID NO: (1)..(1563)
taaattaaagatagcaaaatgagctataagaaaagattgaacgaagagtttgatcctggctcaggatgaacgctgacagaatgcttaacacatgcaagtcaacttgaatttgggtttttaacttaggtttgggtggcggacgggtgagtaacgcgtaaagaacttgcctcacagctagggacaacatttggaaacgaatgctaatacctaatattatgataatagggcatcctataattatgaaagctataagcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaagaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggagtgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagaacagagagtcgcaaagctgtgaagtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttctaagga

SEQ ID NO: 4000 - DNA, 1554 bp, Fusobacterium sp. HMSC065F01
  ref <308>: DATABASE ACCESSION NUMBER: NCBI ACCESSION: NZ_KV813857.1
  ref <309>: DATABASE ENTRY DATE: 2019-04-01
  ref <313>: RELEVANT RESIDUES IN SEQ ID NO: (1)..(1554)
atagcaagaatgagctataagaaaagattgaacgaagagtttgatcctggctcaggatgaacgctgacagaatgcttaacacatgcaagtcaacttgaatttgggtttttaacttagatttgggtggcggacgggtgagtaacgcgtaaagaacttgcctcacagctagggacaacatttagaaatgaatgctaatacctgatattatgattttaaggcatcttagaattatgaaagctataagcactgtgagagagctttgcgtcccattagctagttggagaggtaacagctcaccaaggcgatgatgggtagccggcctgagagggtgaacggccacaaggggactgagacacggcccttactcctacgggaggcagcagtggggaatattggacaatggaccgagagtctgatccagcaattctgtgtgcacgatgaagtttttcggaatgtaaagtgctttcagttgggaagaaagaaatgacggtaccaacagaagaagtgacggctaaatacgtgccagcagccgcggtaatacgtatgtcacgagcgttatccggatttattgggcgtaaagcgcgtctaggtggttatgtaagtctgatgtgaaaatgcagggctcaactctgtattgcgttggaaactgtataactagagtactggagaggtaagcggaactacaagtgtagaggtgaaattcgtagatatttgtaggaatgccgatggggaagccagcttactggacagatactgacgctaaagcgcgaaagcgtgggtagcaaacaggattagataccctggtagtccacgctgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagatagagatatttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctacgatgagtaggaggaaggtggggatgacgtcaagtcatcatgccccttatacgctgggctacacacgtgctacaatgggtagaacagagagttgcaaagccgtgaggtgaagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttctaagga

SEQ ID NO: 4001 - DNA, 1524 bp, Fusobacterium sp. HMSC073F01
  ref <308>: DATABASE ACCESSION NUMBER: NCBI ACCESSION: NZ_KV801512.1
  ref <309>: DATABASE ENTRY DATE: 2019-04-01
  ref <313>: RELEVANT RESIDUES IN SEQ ID NO: (1)..(1524)
taaatagattgaacgaagagtttgatcctggctcaggatgaacgctgacagaatgcttaacacatgcaagtctacttgatccttcgggtgaaggtggcggacgggtgagtaacgcgtaaagaacttgccttacagactgggacaacatttggaaacgaatgctaataccggatattatgactgagtcgcatgatttggttatgaaagctatatgcgctgtgagagagctttgcgtcccattagttagttggtgaggtaacggctcaccaagacgatgatgggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggaagaagtcagtgacggtaccaacagaagaagcgacggctaaatacgtgccagcagccgcggtaatacgtatgtcgcaagcgttatccggatttattgggcgtaaagcgcgtctaggcggtttagtaagtctgatgtgaaaatgcggggctcaaccccgtattgcgttggaaactgctaaactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcccaagaagttaacagagatgttttcgtgcctcttcggaggaacttggtgacaggtggtgcatggctgtcgtcagctcgtgtcgtgagatgttgggttaagtcccgcaacgagcgcaacccctttcgtatgttaccatcattaagttggggactcatgcgagactgcctgcgatgagcaggaggaaggtggggatgacgtcaagtcatcatgccccttatacgctgggctacacacgtgctacaatgggtagtacagagagctgcaaacctgcgagggtaagctaatctcataaaactattcttagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtaacaggcctaaccgtaaggagggatgttccgagggtgtgattagcgattggggtgaagtcgtaacaaggtatccgtacgggaacgtgcggatggatcacctcctttctaagga

SEQ ID NO: 4002 - DNA, 1549 bp, Fusobacterium sp. OBRC1
  ref <308>: DATABASE ACCESSION NUMBER: NCBI ACCESSION: NZ_JANA01000083.1
  ref <309>: DATABASE ENTRY DATE: 2019-04-01
  ref <313>: RELEVANT RESIDUES IN SEQ ID NO: (1)..(1549)
taaataaaaatagcaagaatgagctattaaaaagattgaacgaagagtttgatcctggctcaggatgaacgctgacagaatgcttaacacatgcaagtcaacttgaacttcggtttgggtggcggacgggtgagtaacgcgtaaagaacttgcctcacagatagggacaacatttggaaacgaatgctaatacctgatattatgattttagggcatcctaggattatgaaagctatatgcgctgtgagagagctttgcgtcccattagctagttggagaggtaacggctcaccaaggcgatgatgggtagccggcctgagagggtgatcggccacaaggggactgagacacggcccttactcctacgggaggcagcagtggggaatattggacaatggaccaagagtctgatccagcaattctgtgtgcacgatgaagtttttcggaatgtaaagtgctttcagttgggaagaaaaaaatgacggtaccaacagaagaagtgacggctaaatacgtgccagcagccgcggtaatacgtatgtcacaagcgttatccggatttattgggcgtaaagcgcgtctaggtggttatgtaagtctgatgtgaaaatgcagggctcaactctgtattgcgttggaaactgtgtaactagagtactggagaggtaagcggaactacaagtgtagaggtgaaattcgtagatatttgtaggaatgccgatggggaagccagcttactggacagatactgacgctgaagcgcgaaagcgtgggtagcaaacaggattagataccctggtagtccacgccgtaaacgatgattactaggtgttgggggtcgaacctcagcgcccaagcaaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcttaggaatgagacagagatgtttcagtgtcccttcggggaaacctaaagacaggtggtgcatggctgtcgtcagctcgtgtcgtgagatgttgggttaagtcccgcaacgagcgcaacccctttcgtatgttaccatcattaagttggggactcatgcgatactgcctgcgatgagcaggaggaaggtggggatgacgtcaagtcatcatgccccttatacgctgggctacacacgtgctacaatgggtagtacagagagtcgcaaagccgtgaggtggagctaatctcagaaaactattcttagttcggattgtactctgcaactcgagtacatgaagttggaatcgctagtaatcgcgaatcagcaatgtcgcggtgaatacgttctcgggtcttgtacacaccgcccgtcacaccacgagagttggttgcacctgaagtagcaggcctaaccgtaaggagggatgctccgagggtgtgattagcgattggggtgaagtcgtaacaaggtatccgtacgggaacgtgcggatggatcacctcctttctaagga

SEQ ID NO: 4003 - DNA, 1524 bp, Fusobacterium ulcerans
  ref <308>: DATABASE ACCESSION NUMBER: NCBI ACCESSION: NZ_LS483487.1
  ref <309>: DATABASE ENTRY DATE: 2019-04-01
  ref <313>: RELEVANT RESIDUES IN SEQ ID NO: (1)..(1524)
taaatagattgaacgaagagtttgatcctggctcaggatgaacgctgacagaatgcttaacacatgcaagtctacttgatccttcgggtgaaggtggcggacgggtgagtaacgcgtaaagaacttgccttacagactgggacaacatttggaaacgaatgctaataccggatattatgattgggtcgcatgatctgattatgaaagctatatgcgctgtgagagagctttgcgtcccattagttagttggtgaggtaacggctcaccaagacgatgatgggtagccggcctgagagggtgaacggccacaaggggactgagacacggcccttactcctacgggaggcagcagtggggaatattggacaatggaccaaaagtctgatccagcaattctgtgtgcacgatgaagtttttcggaatgtaaagtgctttcagttgggaagaagtcagtgacggtaccaacagaagaagcgacggctaaatacgtgccagcagccgcggtaatacgtatgtcgcaagcgttatccggatttattgggcgtaaagcgcgtctaggcggcttagtaagtctgatgtgaaaatgcggggctcaaccccgtattgcgttggaaactgctaaactagagtactggagaggtaggcggaactacaagtgtagaggtgaaattcgtagatatttgtaggaatgccgatggggaagccagcctactggacagatactgacgctaaagcgcgaaagcgtgggtagcaaacaggattagataccctggtagtccacgccgtaaacgatgattactaggtgttgggggtcgaacctcagcgcccaagctaacgcgataagtaatccgcctggggagtacgtacgcaagtatgaaactcaaaggaattgacggggacccgcacaagcggtggagcatgtggtttaattcgacgcaacgcgaggaaccttaccagcgtttgacatcccaagaagttaacagagatgttttcgtgcctcttcggaggaacttggtgacaggtggtgcatggctgtcgtcagctcgtgtcgtgagatgttgggttaagtcccgcaacgagcgcaacccctttcgtatgttaccatcattaagttggggactcatgcgagactgcctgcgatgagcaggaggaaggtggggatgacgtcaagtcatcatgccccttatacgctgggctacacacgtgctacaatgggtagtacagagagctgcaaacctgcgagggtaagctaatctcataaaactattcttagttcggattgtactctgcaactcgagtacatgaagttggaatcgctagtaatcgcaaatcagctatgttgcggtgaatacgttctcgggtcttgtacacaccgcccgtcacaccacgagagttggttgcacctgaagtaacaggcctaaccgtaaggagggatgttccgagggtgtgattagcgattggggtgaagtcgtaacaaggtatccgtacgggaacgtgcggatggatcacctcctttctaagga

SEQ ID NO: 4004 - DNA, 1524 bp, Fusobacterium varium; identical to SEQ ID NO: 4001
  ref <308>: DATABASE ACCESSION NUMBER: NCBI ACCESSION: NZ_LR134390.1
  ref <309>: DATABASE ENTRY DATE: 2019-04-01
  ref <313>: RELEVANT RESIDUES IN SEQ ID NO: (1)..(1524)

SEQ ID NO: 4005 - DNA, 1529 bp, Gammaproteobacteria bacterium ESL0073
  ref <308>: DATABASE ACCESSION NUMBER: NCBI ACCESSION: NZ_CP029478.1
  ref <309>: DATABASE ENTRY DATE: 2019-04-01
  ref <313>: RELEVANT RESIDUES IN SEQ ID NO: (1)..(1529)
aaactgaagagtttgatcatggctcagattgaacgctggcggcaggcctaacacatgcaagtcgagcggtaacaggggagcttgctcccgctgacgagcggcggacgggtgagtaaagtctaggaatctgcccagtagtgggggacaacgcggggaaactcgcgctaataccgcatacgccctacgggggaaaggtgctttattgtaccgctattggatgagcctagatcagattagctagttggtggggtaaaggcccaccaaggcgacgatctgtagctggtctgagaggatgatcagccacactgggactgagacacggcccagactcctacgggaggcagcagtggggaatattggacaatgggggaaaccctgatccagccatgccgcgtgtgtgaagaaggtcttcggattgtaaagcactttaagttgggaggaaggggtgaagtaacgactcacctttgacgttaccaacagaataagcaccggctaacttcgtgccagcagccgcggtaatacgaagggtgcaagcgttaatcggaattactgggcgtaaagcgcgcgtaggtggtttatcaagttggatgtgaaatccctgggctcaacctaggaactgcatccaaaactgattgactagagtatagtagaggttagtggaatttcctgtgtagcggtgaaatgcgtagatataggaaggaacaccagtggcgaaggcgactaactggactaatactgacactgaggtgcgaaagcgtggggagcaaacaggattagataccctggtagtccacgctgtaaacgatgtcaactagctgttggaatcctagagattttagtagcgtagctaacgcactaagttgaccgcctggggagtacggtcgcaagattaaaactcaaatgaattgacgggggcccgcacaagcggtggagcatgtggtttaattcgacgcaacgcgaagaaccttacctggccttgacatgtccggaatctttcagagatgagagagtgccttcgggaatcggaacacaggtgctgcatggctgtcgtcagctcgtgtcgtgagatgttgggttaagtcccgtaacgagcgcaacccttatccttagttaccagcacgtaaaggtgggcactttaaggagactgccggtgacaaaccggaggaaggtggggatgacgtcaagtcatcatggcccttacggccagggctacacacgtgctacaatggttggtacagagggtcgccaaactgtaaagtggagctaatctcaaaaaaccaatcgtagtccggattgaagtctgcaactcgacttcatgaagtcggaatcgctagtaatcgcgaatcagaatgtcgcggtgaatacgttcccgggccttgtacacaccgcccgtcacaccatgggagtgggttgctccagaagtagctaggctaacctcgtgaggccggttaccacggagtgattcatgactggggtgaagtcgtaacaaggtagccgtaggggaacctgcggctggatcacctccttaa

SEQ ID NO: 4006 - DNA, 1537 bp, Gardnerella vaginalis
  ref <308>: DATABASE ACCESSION NUMBER: NCBI ACCESSION: NZ_LR134385.1
  ref <309>: DATABASE ENTRY DATE: 2019-04-01
  ref <313>: RELEVANT RESIDUES IN SEQ ID NO: (1)..(1537)
tttcgtggagggttcgattctggctcaggatgaacgctggcggcgtgcttaacacatgcaagtcgaacgggatctgaccagcttgctggttggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagccttttgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtttgcgccgggtacgggcgggctagagtgcagtaggggagactggaattctcggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttctgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgacgactgcagagatgtggtttcctttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccagtacaacgggttgcttcatggtgacatggtgctaatcccttaaaactggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttctacggag

SEQ ID NO: 4007 - DNA, 1489 bp, Geitlerinema sp. PCC 7105
  ref <308>: DATABASE ACCESSION NUMBER: NCBI ACCESSION: NZ_KB235958.1
  ref <309>: DATABASE ENTRY DATE: 2019-04-01
  ref <313>: RELEVANT RESIDUES IN SEQ ID NO: (1)..(1489)
aacacggagagtttgatcctggctcaggatgaacgctggcggcgtgcctaacacatgcaagtcgaacgaagtcttcggacttagtggcggacgggtgagtaacgcgtgagaacctgcctcgaggagggggataacagcgggaaactgctgctaataccccatatgccgaaaggtgaaaagaaatttgccttgagaggggctcgcgtccgattagctagttggtgaggtaagagcttaccaaggcgacgatcggtagctggtctgagaggatgagcagccacactgggactgagacacggcccagactcctacgggaggcagcagtggggaattttccgcaatgggcgaaagcctgacggagcaacgccgcgtgggggaagaaggcctttgggttgtaaactccttttctcagggaagaagaactgacggtacctgaggaatcagcctcggctaactccgtgccagcagccgcggtaatacggaggaggcaagcgttatccggaattattgggcgtaaagcgttcgtaggcggcgtttcaagtctgctgtcaaaggccgaggctcaacttcggaaaggcagtggaaactgaaaagctagaggtcggtaggggcagagggaattcccagtgtagcggtgaaatgcgtagatattgggaagaacaccggtggcgaaagcgctctgctgggccgaacctgacgctgagggacgaaagctaggggagcgaatgggattagataccccagtagtcctagccgtaaacgatggagactaggtgttgcctgtatcgacccgggcagtgccgaagccaacgcgttaagtctcccgcctggggagtacgcacgcaagtgtgaaactcaaaggaattgacgggggcccgcacaagcggtggagtatgtggtttaattcgatgcaacgcgaagaaccttaccagggcttgacatcccgcgaatctcggcgaaagttgagagtgcctacgggaacgcggagacaggtggtgcatggctgtcgtcagctcgtgtcgtgagatgttgggttaagtcccgcaacgagcgcaaccctcgtccttagttgccatccttaagtggggcactctagggagactgccggtgataaaccggaggaaggtggggatgacgtcaagtcatcatgccccatatgtcctgggcgacacacgtactacaatggtcgggacagcgagcagccaacttgcgaaagtgagctaatctctcaaacccggcctcagttcagattgcaggctgcaactcgcctgcatgaaggaggaatcgctagtaatcgcaggtcagcatactgcggtgaatccgttcccgggccttgtacacaccgcccgtcacaccatggaagtcggccatgcccgaagtcattactctaaccgttcgcggaggagggtgccgaaggcagggctgatgactggggtgaagtcgtaacaaggtagccgtaccggaaggtgtggctggatcacctcctttt

SEQ ID NO: 4008 - DNA, 1492 bp, Geitlerinema sp. PCC 7407
  ref <308>: DATABASE ACCESSION NUMBER: NCBI ACCESSION: NC_019703.1
  ref <309>: DATABASE ENTRY DATE: 2019-04-01
  ref <313>: RELEVANT RESIDUES IN SEQ ID NO: (1)..(1492)
aacacggagagtttgatcctggctcaggatgaacgctggcggcgtgcttaacacatgcaagtcgaacgaagtcttcggacttagtggcggacgggtgagtaacgcgtgagaatctgccctcaggagggggataacgagttggaaacgactgctaagaccccatatgccgaaaggtgaaataattttttgcctgaggatgagctcgcgtctgattagctagttggtgaggtaagagctcaccaaggcgacgatcagtagctggtctgagaggatgatcagccacactgggactgagacacggccaagactcctacgggaggcagcagtggggaattttccgcaatgggcgaaagcctgacggagcaacgccgcgtgagggaggaaggcctgtgggttgtaaacctcttttctcagggaagaagatctgacggtacctgaggaatcagcatcggctaactccgtgccagcagccgcggtaagacggaggatgcaagcgttatccggaattattgggcgtaaagcgtccgcaggcggctcagcaagtctgctgtcaaagagcggggctcaactccgtaagggcagtggaaactgctgggctagagtatggtaggggcagagggaattcccggtgtagcggtgaaatgcgtagatatcgggaagaacaccagtggcgaaagcgctctgctgggccataactgacgctcatggacgaaagctaggggagcgaatgggattagataccccagtagtcctagccgtaaacgatggagactaggtgttgcttgtatcgacccaagcagtgccgtagctaacgcgttaagtctcccgcctggggagtacgcacgcaagtgtgaaaactcaaaggaattgacgggggcccgcacaagcggtggagtatgtggtttaattcgatgcaacgcgaagaaccttaccaaggcttgacatgtcgcgaaccctgctgaaaggcgggggtgcctacgggagcgcgaacacaggtggtgcatggctgtcgtcagctcgtgtcgtgagatgttgggttaagtcccgcaacgagcgcaaccctcgttcttagttgccatcattaagttgggcactctagggagactgccggtgacaaaccggaggaaggtggggatgacgtcaagtcagcatgccccttacgtcttgggctacacacgtactacaatgcttcggacagagggcagcaagcgcgcgagtgcaagccaatcccataaaccgaggctcagttcagattgcaggctgcaactcgcctgcatgaaggcggaatcgctagtaatcgcaggtcagcatactgcggtgaatacgttcccgggccttgtacacaccgcccgtcacaccatgggagctggccacgcccgaagtcgttactctaaccgttcgcggaggaggacgccgaaggcagggctggtgactggggtgaagtcgtaacaaggtagccgtaccggaaggtgtggctggatcacctcctttt

SEQ ID NO: 4009 - DNA, 1493 bp, Geitlerinema sp. PCC 9228
  ref <308>: DATABASE ACCESSION NUMBER: NCBI ACCESSION: NZ_LNDC01000056.1
  ref <309>: DATABASE ENTRY DATE: 2019-04-01
  ref <313>: RELEVANT RESIDUES IN SEQ ID NO: (1)..(1493)
cacggagagtttgatcctggctcaggatgaacgctggcggtcggcttaacacatgcaagtcgaacgggttcttcggaaccagtggcggacgggtgagtaacacgtgagaacctgcctaccggagggggataacagcgggaaactgctgctaataccccatacgccgagaggtaaaaggtcagccgccgggagaggggctcgcgtccgattagctagttggtggggtaagagctcaccaaggcgacgatcggtagccgttttgagaggaagaacggccacactgggactgagacacggcccagactcctacgggaggcagcagtggggaatcttccgcaatgggcgcaagcctgacggagccagaccgcgtgggggaggaaggcccttgggttgtaaaccccttttctcagggaagaaacctgacggtacctgaggaaaaagcctcggctaactccgtgccagcagccgcggtaatacggaggaggcaagcgttatccggaattactgggcgtaaagcgttcgtagggggctcgtcaagtctgctgtcaaagctcggagctcaactccgaaggggcagtggaaactggggagctagagggcggcaggggcagaaggaattcccggtgtagcggtgaaatgcgtagagatcgggaagaacaccagaggcgaaagcgttctgctgggccgcgcctgaccctgagggacgaaagccaggggagcgaatgggattagataccccagtagtcctggctgtaaacgatggatactaggtattggccgtatcgacccggtcggcgccgaagctaacgcgttaagtatcccgcctggggagtacgcacgcaagtgtgaaactcaaaggaattgacgggggcccgcacaagcggtggagtatgtggtttaattcgatgcaacgcgaagcaccttaccagggcttgacatgccgcgaaccccagggaaacttgggggtgcctacgggagcgcggacacaggtggtgcatggctgtcgtcagctcgtgtcgtgagatgttgggttaagtcccgcaacgagcgcaaccctcgtccttagttgccagcattcagttgggccctctagggagactgccggtgacaaaccggaggaaggtggggatgacgtcaagtcatcatgccccttatgccctgggcgacacacgtactacaatggttgggacagagggaagcgaagccgcgaggtggagccaatcccacaaacccagcctcagttcagattgcaggctgcaactcgcctgcatgaaggcggaatcgctagtaatcgccggtcagcatacggcggtgaatacgttcccgggccttgtacacaccgcccgtcacaccatggaagctggccacgcccgaagtcgttactccaaccctgaggggaggaggacgccgaaggcagggctggtgactggggtgaagtcgtaacaaggtagccgtaccggaaggtgtggctggatcacctcctttacagggag

SEQ ID NO: 4010 - DNA, 1564 bp, Gemella asaccharolytica
  ref <308>: DATABASE ACCESSION NUMBER: NCBI ACCESSION: NZ_KQ959871.1
  ref <309>: DATABASE ENTRY DATE: 2019-04-01
  ref <313>: RELEVANT RESIDUES IN SEQ ID NO: (1)..(1564)
aaaattggagagtttgatcctggctcaggacgaacgctggcggcgtgcctaatacatgcaagtcgagcggactttaagagtgcttgcacacttaaagttagcggcgaacgggtgagtaacacgtaaagaacctaccttatagacagggacaactattggaaacgatagctaatacctgataagaaagaaactcgcatgagagaagttcgaaagtcggagcaatctgacactataagatggctttgcggtgcattagctagttggtagggtaaaagcctaccaaggcgacgatgcatagccgacctgagagggtgatcggccacattgggactgagacacggcccagactcctacgggaggcagcagtagggaatcttccgcaatggacgaaagtctgacggagcaacgccgcgtgagtgaagaaggatttcggttcgtaaaactctgttgttagggaagaaaaaatgtatagtaactatatacaaaagagacggtacctaaccagaaagccacggctaactacgtgccagcagccgcggtaatacgtaggtggcaagcgttgtccggaattattgggcgtaaagcgcgcgcaggtggtttagaaagtctgatgtgaaagcccacggctcaaccgtggagggtcattggaaactaataaacttgagtgcaggagagaaaagtggaattcctagtgtagcggtgaaatgcgtagagattaggaggaacaccggtggcgaaagcggctttttggcctgcaactgacactgaggcgcgaaagcgtggggagcaaacaggattagataccctggtagtccacgccgtaaacgatgagtgctaagtgttggagtcaaaagacttcagtgctgcagcaaacgcattaagcactccgcctggggagtacgatcgcaagattgaaactcaaaggaattgacggggacccgcacaagcggtggagtatgtggtttaattcgaagcaacgcgaagaaccttaccaagtcttgacatacagtgaagatataagaaattatattgttttaatgtttacattaaacactgatacaggtggtgcatggttgtcgtcagctcgtgtcgtgagatgttgggttaagtcccgcaacgagcgcaacccttatatctagttaccagcagtaagatggggactctagatagactgccagtgacaaactggaggaaggtggggatgacgtcaaatcatcatgccccttatgacttgggctacacacgtactacaatggataggaacaaagagaagcgacctcgcaagagcaagccaacctcagaaaactattctcagttcggattgtaggctgcaactcgcctacatgaagctggaatcgctagtaatcgcgaatcagaatgtcgcggtgaatacgttcccgggtcttgtacacaccgcccgtcacaccacgagagtttgtaacacctgaagacggtggcctaaccgtaaggagggagccggtcacggtgggacagatgattggggtgaagtcgtaacaaggtagccgtatcggaaggtgcggctggatcacctcctttctaagga

SEQ ID NO: 4011 - DNA, 814 bp, Gemella bergeri
  ref <308>: DATABASE ACCESSION NUMBER: NCBI ACCESSION: NZ_KI271840.1
  ref <309>: DATABASE ENTRY DATE: 2019-04-01
  ref <313>: RELEVANT RESIDUES IN SEQ ID NO: (1)..(814)
ttttggcctgcaactgacactgaggcgcgaaagcgtggggagcaaacaggattagataccctggtagtccacgccgtaaacgatgagtgctaagtgttggtctcaaaagagatcagtgctgcagcaaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacataagagattatgttgtttgtcttttttagacaacacagatacaggtggtgcatggttgtcgtcagctcgtgtcgtgagatgttgggttaagtcccgcaacgagcgcaacccttatatctagttgccagcagtaagatggggactctagatagactgccagtgacaaactggaggaaggtggggatgacgtcaaatcatcatgccccttatgacttgggctacacacgtgctacaatggatagggacaaagagaagcgaacttgtaaaggcaagccaatctcataaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacctgaagacggtgacctaaccgaaagggaggagccggtcacggtgggacagatgattggggtgaagtcgtaacaaggtagccgtatcggaaggtgcggctggatcacctcctttcta

SEQ ID NO: 4012 - DNA, 1561 bp, Gemella cuniculi
  ref <308>: DATABASE ACCESSION NUMBER: NCBI ACCESSION: NZ_AUDW01000037.1
  ref <309>: DATABASE ENTRY DATE: 2019-04-01
  ref <313>: RELEVANT RESIDUES IN SEQ ID NO: (1)..(1561)
tttggagagtttgatcctggctcaggacgaacgctggcggcgtgcctaatacatgcaagtcgagcgaagatatctggtgcttgcactagataacttagcggcgaacgggtgagtaacacgtaaagaacctgcctcatagactgggacaactacgggaaactgtagctaataccggataacagaattaaccgcatggttaatatttaaaagttggtcaagctaacactatgagatggctttgcggtgcattagctagttggtagggtaaaggcctaccaaggcgacgatgcatagccgacctgagagggtgaacggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaaaggttgtgtagtaactatacacaaaacagacggtacctaaccagaaagccacggctaactacgtgccagcagccgcggtaatacgtaggtggcaagcgttgtccggaattattgggcgtaaagcgcgcgcaggtggtttaaaaagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagcaaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaagagataagagattatgttgttctggcctatggttagacacagatacaggtggtgcatggttgtcgtcagctcgtgtcgtgagatgttgggttaagtcccgcaacgagcgcaacccttatatctagttgccagcagtaagatggggactctagatagactgccagtgataaactggaggaaggtggggatgacgtcaaatcatcatgccccttatgacttgggctacacacgtgctacaatggataggaacaaagagaagcgaaggcgcaagttggagcgaacctcacaaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaacctttataggagggagccggtcacggtgggacagatgattggggtgaagtcgtaacaaggtagccgtatcggaaggtgcggctggatcacctcctttctaagga

SEQ ID NO: 4013 - DNA, 1560 bp, Gemella haemolysans
  ref <308>: DATABASE ACCESSION NUMBER: NCBI ACCESSION: NZ_LR134484.1
  ref <309>: DATABASE ENTRY DATE: 2019-04-01
  ref <313>: RELEVANT RESIDUES IN SEQ ID NO: (1)..(1560)
tggagagtttgatcctggctcaggacgaacgctggcggcgtgcctaatacatgcaagtcgagcgaagtttttctggtgcttgcaccggaaaaacttagcggcgaacgggtgagtaacacgtaaagaacctgcctcatagactgggacaactattggaaacgatagctaataccggataacagcattaactgcatggttgatgtttaaaagttggttttgctaacactatgagatggctttgcggtgcattagctagttggtggggtaaaggcctaccaaggcgacgatgcatagccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaatgattgtgtagtaactatacacagtagagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacacaagagattgtgttgttctgacctttggttagacacagatacaggtggtgcatggttgtcgtcagctcgtgtcgtgagatgttgggttaagtcccgcaacgagcgcaacccttatatctagttgccagcagtaagatggggactctagatagactgccagtgataaactggaggaaggtggggatgacgtcaaatcatcatgccccttatgacttgggctacacacgtgctacaatggataggaacaaagagaagcgagctcgcgagagtaagcaaacctcacaaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaaccttttaggagggagccggtcacggtgggacagatgattggggtgaagtcgtaacaaggtagccgtatcggaaggtgcggctggatcacctcctttctaagga

SEQ ID NO: 4014 - DNA, 1554 bp, Gemella massiliensis
  ref <308>: DATABASE ACCESSION NUMBER: NCBI ACCESSION: NZ_LT635543.1
  ref <309>: DATABASE ENTRY DATE: 2019-04-01
  ref <313>: RELEVANT RESIDUES IN SEQ ID NO: (1)..(1554)
ggagagtttgatcctggctcaggacgaacgctggcggcgtgcctaatacatgcaagtcgagcgaagaattattggtgcttgcaccgataattcttagcggcgaacgggtgagtaacacgtaaagaacctgccttatagaccgggataactatgggaaactgtagctaataccggataacagtattttccgcatgggagatatttaaaagtcggtcatgctgacactataagatggctttgcggagcattagctagttggtgggataaaagcctaccaaggcgacgatgcatagccgacctgagagggtgaacggccacattgggactgagacacggcccaaactcctacgggaggcagcagtagggaatcttccgcaatggacgaaagtctgacggagcaacgccgcgtgagtgaagaaggatttcggttcgtaaagctctgttgttagggaagaaaggttgtgtagtaactatacacaaaacagacggtacctaaccagaaagccacggctaactacgtgccagcagccgcggtaatacgtaggtggcaagcgttgtccggaattattgggcgtaaagcgcgcgcaggtggtttagaaagtctgatgtgaaagctcacggctcaaccgtggaaggtcattggaaactgataaacttgagtgcaggagagaaaagtggaattcctagtgtagcggtgaaatgcgtagagattaggaggaacaccagtggcgaaggcggctttttggcctgcaactgacactgaggcgcgaaagcgtggggagcaaacaggattagataccctggtagtccacgccgtaaacgatgagtgctaagtgttggtctcaaaagagatcagtgctgcagcaaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgagggcgtgagagatcacgttgtttgtctctttgagacaacacagatacaggtggtgcatggttgtcgtcagctcgtgtcgtgagatgttgggttaagtcccgcaacgagcgcaacccttatatctagttgccagcagtaagatggggactctagatagactgccagtgacaaactggaggaaggtggggatgacgtcaaatcatcatgccccttatgacttgggctacacacgtgctacaatggatagggacaaagagaagcgagcttgtaaaagtaagccaatctcataaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacctgaagacggtgacctaaccgaaagggaggagccggtcacggtgggacagatgattggggtgaagtcgtaacaaggtagccgtatcggaaggtgcggctggatcacctcctttcta

SEQ ID NO: 4015 - DNA, 1558 bp, Gemella morbillorum
  ref <308>: DATABASE ACCESSION NUMBER: NCBI ACCESSION: NZ_LS483440.1
  ref <309>: DATABASE ENTRY DATE: 2019-04-01
  ref <313>: RELEVANT RESIDUES IN SEQ ID NO: (1)..(1558)
gagagtttgatcctggctcaggacgaacgctggcggcgtgcctaatacatgcaagtcgagcgaagtttttctggtgcttgcactagaaaaacttagcggcgaacgggtgagtaacacgtaaagaacctgcctcatagactgggacaactattggaaacgatagctaataccggataacagtatttctcgcatgagagatatttaaaagttggttatgctaacactatgagatggctttgcggtgcattagctagttggtggggtaaaggcccaccaaggcgacgatgcatagccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaatggatatgtagtaactatacatgtaagagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacacaagagattgtgttgttctgacctttggttagacacagatacaggtggtgcatggttgtcgtcagctcgtgtcgtgagatgttgggttaagtcccgcaacgagcgcaacccttatatctagttgccagcagtaagatggggactctagatagactgccagtgataaactggaggaaggtggggatgacgtcaaatcatcatgccccttatgacttgggctacacacgtgctacaatggataggaacaaagagaagcgagctcgcgagagtcagccaacctcataaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaacctttaaggagggagccggtcacggtgggacagatgattggggtgaagtcgtaacaaggtagccgtatcggaaggtgcggctggatcacctcctttctaagga

SEQ ID NO: 4016 - DNA, 1561 bp, Gemella sanguinis
  ref <308>: DATABASE ACCESSION NUMBER: NCBI ACCESSION: NZ_PNGT01000019.1
  ref <309>: DATABASE ENTRY DATE: 2019-04-01
  ref <313>: RELEVANT RESIDUES IN SEQ ID NO: (1)..(1561)
tggagagtttgatcctggctcaggacgaacgctggcggcgtgcctaatacatgcaagtcgagcgaagtttttctggtgcttgcactagaaaaacttagcggcgaacgggtgagtaacacgtaaagaacctgcctcatagacggggacaactattggaaacgatagctaataccggataacagcataaatcgcatgatatatgtttaaaagttggtttcggctaacactatgagatggctttgcggtgcattagctagttggtggggtaaaggcctaccaaggcgacgatgcatagccgacctgagagggtgatcggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaatgattgtatagtaactatatacagtagagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacacaagagattgtgttgttctgacctttggttggacacagatacaggtggtgcatggttgtcgtcagctcgtgtcgtgagatgttgggttaagtcccgcaacgagcgcaacccctatgtctagttgccagcagtaagatggggactctagacagactgccagtgataaactggaggaaggcggggatgacgtcaaatcatcatgccccttatgacttgggctacacacgtgctacaatggataggaacaaagagaagctaactcgcgagagcaagcaaacctcataaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaacctttaaggagggagccggtcacggtgggacagatgattggggtgaagtcgtaacaaggtagccgtatcggaaggtgcggctggatcacctcctttctaagga

SEQ ID NO: 4017 - DNA, 1554 bp, Gemella sp. ND 6198; identical to SEQ ID NO: 4014
  ref <308>: DATABASE ACCESSION NUMBER: NCBI ACCESSION: NZ_CP022615.1
  ref <309>: DATABASE ENTRY DATE: 2019-04-01
  ref <313>: RELEVANT RESIDUES IN SEQ ID NO: (1)..(1554)

SEQ ID NO: 4018 - DNA, 1554 bp, Gemella sp. oral taxon 928; identical to SEQ ID NO: 4014
  ref <308>: DATABASE ACCESSION NUMBER: NCBI ACCESSION: NZ_CP014233.1
  ref <309>: DATABASE ENTRY DATE: 2019-04-01
  ref <313>: RELEVANT RESIDUES IN SEQ ID NO: (1)..(1554)

SEQ ID NO: 4019 - DNA, 1489 bp, Geminicoccus roseus
  ref <308>: DATABASE ACCESSION NUMBER: NCBI ACCESSION: NZ_KE386572.1
  ref <309>: DATABASE ENTRY DATE: 2019-04-01
  ref <313>: RELEVANT RESIDUES IN SEQ ID NO: (1)..(1489)
tcaagctgagagtttgatcctggctcagaacgaacgctggcggcgcgcctaacacatgcaagtcggacgcactcgcaagagtgagtggcggacgggtgagtaacacgtgggaacctgccctggggtctgggatagctgcgggaaactgcaggtaacaccggatacgcacgggagtggaaagttcacgccctgggatgggcccgcgtcggattaggtagttggtggggtaacggcctaccaagcctgcgatccgtaaccggtctgagaggatgatcggtcacactgggactgagacacggcccagactcctacgggaggcagcagtggggaatcttggacaatgggggcaaccctgatccagcgacgccgcgtgggtgatgaaggccttcgggtcgtaaagcccttttgccggggaagatgatgacggtacccggagaagaagcaccggctaactctgtgccagcagccgcggtaagacagagggtgctagcgttgttcggaattactgggcgtaaagggcgcgtaggcggctcgtttagtcgggtgtgaaatcccggggctcaaccccggaactgcattcgatactggcgggcttgagaccgagagaggtgggtggaatacccagtgtagaggtgaaattcgtagatattgggtggaacaccggtggcgaaggcggctcactggctcggatctgacgctgaggcgcgaaagcgtggggagcaaacaggattagataccctggtagtccacgccctaaacgatgtgtgctagatgtcgggggacttgtctctcggtgtcggagttaacgttttaagcacaccgcctggggagtacggccgcaaggttaaaactcaaaggaattgacgggggcccgcacaagcggtggagcatgtggtttaattcgacgcaacgcgcagaaccttaccaactcttgacatggccgttaaagctgctgagaggcagtgtcccgcaagggggcggttacaggtgctgcatggctgtcgtcagctcgtgtcgtgagatgttgggttaagtcccgcaacgagcgcaacccttgtccgtagttgccatcaggttgggctgggcactctacggggactgccggtgacaagccggaggaaggtggggatgacgtcaagtcctcatggcccttacgagttgggctacacacgtgctacaatggtggtgacagagggcagccaggtcgcgaggccgagcaaatccctaaaagccatctcagttcggattgcactctgcaactcgagtgcatgaaggtggaatcgctagtaatcgcggatcagcacgccgcggtgaatacgttcccgggccttgtacacaccgcccgtcacaccatgggagttggttcgaccttaagccggtgagctaacctcgcaagagggggcagccgaccacggtcgggtcagcgactggggtgaagtcgtaacaaggtagccgtaggggaacctgcggctggatcacctcctttctg

SEQ ID NO: 4020 - DNA, 1568 bp, Geminisphaera colitermitum
  ref <308>: DATABASE ACCESSION NUMBER: NCBI ACCESSION: NZ_ABEA03000104.1
  ref <309>: DATABASE ENTRY DATE: 2019-04-01
  ref <313>: RELEVANT RESIDUES IN SEQ ID NO: (1)..(1568)
ttttcggagagtttgatcctggctcagaatgaacgctggcggcgtggttaagacatgcaagtcgaacgggatttatgatgtagcaatacattgtgaatctagtggcgaacgggtgcgtaacacgtgaacaatctacttcttagtgtggaataattcgccgaaaggtggactaataccgcatgtggttgtttccctcatgggaagcatactaaaggcagggaccgcaaggcctgccgctaggaaaggagttcgcggcctatcagctagttggtgaggtaacggctcaccaaggcaaagacgggtagccggtctgagaggatgatcggccacactggaactgagacacggtccagacacctacgggtggcagcagtttcgaatcattcacaatgggcgaaagcctgatggtgcgacgccgcgtgagggatgaaggtcttcggattgtaaacctctgtcactagggaagaaacgctggctattaatagtcgtccagcctgacttaacctggagaggaagcagtggctaactctgtgccagcagccgcggtaatacagagactgcaagcgttattcggattcactgggcgtaaagggtgcgcaggcggttgtgtgtgtcaggtgtgaaatctcggggcttaactccgaaactgcgcctgaaactacacaactagagtattggagagggtagcagaattcatggtgtagcagtgaaatgcgtagatatcatgaggaataccagaggcgaaggcggctacctggacaattactgacgctcaggcacgaaagcgtggggagcaaaagggattagatacccctgtagtccacgccctaaacggtgcatactaggtcttggaggattcgaccccttcagggcccaagctaacgcgttaagtatgccgcctgaggactacggccgcaaggctaaaactcaaaggaattgacgggggcccgcacaagcggtggagtatgtggcttaattcgatgcaacgcgaagaaccttacctagccttgacatgcattagacagacgctgaaaggcgtccttccttcgggactggtgcacaggtgctgcatggctgtcgtcagctcgtgtcgtgagatgttgcgttaagtcgcgcaacgagcgcaacccctgtccttagttgccatcattaagttgggcactttaaggagacaaaccctctctgagggtgggaaggtggggatgacgtcaagtcaggatggcccttacggctagggctgcacacgtactacaatgcccgatacagagagatgcaataccgtgaggtggagctaatcttcaaaatcgggcccagttcggattgttgtctgcaactcgacaacatgaagttggaatcgctagtaatggcgcatcagctacggcgccgtgaatacgttcccgggccttgtacacaccgcccgtcacatcatgaaagccggttttgcccaaagtgcgtttgccaaccagcaatggaggcggcgccctaaggtgaggctggtgattgggatgaagtcgtaacaaggtaaccgtaggggaacctgcggttggatcacctcctttctaaggaga

SEQ ID NO: 4021 - DNA, 1491 bp, Geminocystis herdmanii
  ref <308>: DATABASE ACCESSION NUMBER: NCBI ACCESSION: NZ_CM001775.1
  ref <309>: DATABASE ENTRY DATE: 2019-04-01
  ref <313>: RELEVANT RESIDUES IN SEQ ID NO: (1)..(1491)
aatggagagtttgatcctggctcaggatgaacgctggcggtatgcttaacacatgcaagtcgaacggtctcttcggagatagtggcggacgggtgaggaacgcgtgagaatctgcctttaggtcggggacaacatttggaaacgaatgctaataccggatgagctgagaagtaaaagatttatcgcctaaagaggagctcgcgtctgattagctagatggtagtgtaaaggactaccatggccacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaacttagggaagaaaaaaatgacggtacctaatataagcatcggctaactccgtgccagcagccgcggtaatacggaggatgcaagcgttatccggaatcattgggcgtaaagcgtccgtaggtggcatttcaagtctgctgtcaaagaccgaagctcaacttcgggtaggcggtggaaactgaaaagctagagtatagtaggggtagagggaattcctagtgtagcggtgaaatgcgtagagattaggaagaacaccagtggcgaaggcgctctactgggcatatactgacactgagggacgaaagctagggtagcgaaagggattagatacccctgtagtcttagcggtaaacgatggatactaggtgttgtctgtatcgacccggacagtgccgaagcaaacgcgttaagtatcccgcctggggagtacgcacgcaagtgtgaaactcaaaggaattgacggggacccgcacaagcggtggagtatgtggtttaattcgatgcaacgcgaagaaccttaccaaggcttgacatcctgtgaatctttctgaaaggagagagtgccttagggaacacagagacaggtggtgcatggctgtcgtcagctcgtgtcgtgagatgttgggttaagtcccgcaacgagcgcaaccctcgtccttagttgccagcattaagttggggactctagggagaccgccggggagaactcggaggaaggtggggatgacgtcaagtcagcatgccccttacgtcttgggctacacacgtactacaatggttgggacaaagggaggcgaaactgcgaagtggagcgaatcctgtcaaacccagccccagttcagattgcaggctgaaactcgcctgcatgaaggaggaatcgctagtaatcgcaggtcagcatactgcggtgaatccgttcccgggtcttgtacacaccgcccgtcacaccatggaagttggtcacgcccgaagtcgttacctcaaccgtttacggagagggatgccgaaggtgggactagtgactggggtgaagtcgtaacaaggtagccgtaccggaaggtgtggctggatcacctccttaaaggg

SEQ ID NO: 4022 - DNA, 1491 bp, Geminocystis sp. NIES-3708
  ref <308>: DATABASE ACCESSION NUMBER: NCBI ACCESSION: NZ_AP014815.1
  ref <309>: DATABASE ENTRY DATE: 2019-04-01
  ref <313>: RELEVANT RESIDUES IN SEQ ID NO: (1)..(1491)
aatggagagtttgatcctggctcaggatgaacgctggcggtatgcttaacacatgcaagtcgaacggtcacttaggtgatagtggcggacgggtgaggaacacgtgagaatctgccttgaggtcggggacaacagttggaaacgactgctaataccggatgagctgagaagtaaaagatttatcgcctgaagaggagctcgcgtctgattagctagatggtagtgtaatggactaccatggcgacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaacttagggaagaagaaagtgacggtacctaatataagcatcggctaactccgtgccagcagccgcggtaatacggaggatgcaagcgttatccggaatcattgggcgtaaagcgtccgtaggtggcatttcaagtctgctgtcaaagaccgaagctcaacttcgggtaggcggtggaaactgaaaagctagagtatagtaggggtagagggaattcctagtgtagcggtgaaatgcgtagagattaggaagaacaccagtggcgaaggcgctctactgggcatatactgacactgagggacgaaagctagggtagcgaaagggattagatacccctgtagtcctagcggtaaacgatggatactaggtgttgtctgtatcgacccagacagtgccgaagcaaacgcgttaagtatcccgcctggggagtacgcacgcaagtgtgaaactcaaaggaattgacggggacccgcacaagcggtggagtatgtggtttaattcgatgcaacgcgaagaaccttaccaaggcttgacatcctgcgaatcttttggaaacgaaagagtgccttagggaacgcagagacaggtggtgcatggctgtcgtcagctcgtgtcgtgagatgttgggttaagtcccgcaacgagcgcaaccctcgtccttagttgccagcattaagttggggactctagggagaccgccggggagaactcggaggaaggtggggatgacgtcaagtcagcatgccccttacgtcttgggctacacacgtactacaatggttgagacaaagggaagcgaagctgcgaagtggagcgaatcccagcaaactcagccccagttcagattgcaggctgaaactcgcctgcatgaaggaggaatcgctagtaatcgcaggtcagcatactgcggtgaatccgttcccgggtcttgtacacaccgcccgtcacaccatggaagttggtcacgcccgaagtcgttactccaacctgtaaaggaggaggatgccgaaggtgggactagtgactggggtgaagtcgtaacaaggtagccgtaccggaaggtgtggctggatcacctccttaaaggg

SEQ ID NO: 4023 - DNA, 1489 bp, Geminocystis sp. NIES-3709
  ref <308>: DATABASE ACCESSION NUMBER: NCBI ACCESSION: NZ_AP014821.1
  ref <309>: DATABASE ENTRY DATE: 2019-04-01
  ref <313>: RELEVANT RESIDUES IN SEQ ID NO: (1)..(1489)
aatggagagtttgatcctggctcaggatgaacgctggcggtatgcttaacacatgcaagtcgaacggtctcttcggagatagtggcggacgggtgaggaacgcgtgagaatctgccttgaggtcggggacaacagttggaaacgactgctaataccggatgagctgagaagtaaaagatttattgcctcaagaggagctcgcgtctgattagctagatggtggggtaaaggcctaccatggcgacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaacttagggaagaaaaaaatgacggtacctaatataagcatcggctaactccgtgccagcagccgcggtaatacggaggatgcaagcgttatccggaatcattgggcgtaaagcgtccgtaggtggcatttaaagtctgctgtcaaagaccgaagctcaacttcgggtaggcggtggaaactaaaaagctagagtatagtaggggtagagggaattcctagtgtagcggtgaaatgcgtagagattaggaagaacaccagtggcgaaggcgctctactgggcatatactgacactgagggacgaaagctagggtagcgaaagggattagatacccctgtagtcctagcggtaaacgatggatactaggtgttgtctgtatcgacccggacagtgccgaagcaaacgcgttaagtatcccgcctggggagtacgcacgcaagtgtgaaactcaaaggaattgacggggacccgcacaagcggtggagtatgtggtttaattcgatgcaacgcgaagaaccttaccaaggcttgacatcctgcgaatcttttagaaatagaagagtgccttagggaacgcagagacaggtggtgcatggctgtcgtcagctcgtgtcgtgagatgttgggttaagtcccgcaacgagcgcaaccctcgtccttagttgccatcattaagttggggactctagggagaccgccggggagaactcggaggaaggtggggatgacgtcaagtcagcatgccccttacgtcttgggctacacacgtactacaatggttgagacaaagggaagcgaaactgcgaagtggagcgaatcctgtcaaactcagccccagttcagattgcaggctgaaactcgcctgcatgaaggaggaatcgctagtaatcgcaggtcagcatactgcggtgaatccgttcccgggtcttgtacacaccgcccgtcacaccatggaagttggtcatgcccgaagtcgttaccttaaccgcaaggagagggatgccgaaggtgggactagtgactggggtgaagtcgtaacaaggtagccgtaccggaaggtgtggctggatcacctccttaaaggg

SEQ ID NO: 4024 - DNA, 1470 bp, Gemmobacter caeni
  ref <308>: DATABASE ACCESSION NUMBER: NCBI ACCESSION: NZ_QBKP01000051.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcctaacacatgcaagtcgagcgaggacttcggtcctagcggcggacgggtgagtaacgcgtgggaacgtgccctttggttcggaatagccccgggaaactgggagtaataccggataagccctgcgggggaaagatttatcgccaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgactgtaccagcagaagaagccccggctaactccgtgccagcagccgcggtaatacggagggggctagcgttgttcggaattactgggcgtaaagcgcacgtaggcggactggaaagttgggggtgaaatcccggggctcaacctcggaactgccttcaaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggcagtgaccgttccagagatggtcctttctcgcaagagacactgcacacaggtgctgcatggctgtcgtcagctcgtgtcgtgagatgttcggttaagtccggcaacgagcgcaacccacgcctttagttgccagcattcagttgggcactctaaaggaactgccggtgataagccggaggaaggtgtggatgacgtcaagtcctcatggcccttacgggttgggctacacacgtgctacaatggtggtgacaatgggttaatcccaaaaagccatctcagttcggattgtcgtctgcaactcggcggcatgaagtcggaatcgctagtaatcgcgtaacagcatgacgcggtgaatacgttcccgggccttgtacacaccgcccgtcacaccatgggaattggatccacccgaaggcggtgcgccaaccagcaatggaggcagccgaccacggtgggttcagtgactggggtgaagtcgtaacaaggtagccgtaggggaacctgcggctggatcacctcctttctaa

SEQ ID NO: 4025 - DNA, 1469 bp, Gemmobacter intermedius
  ref <308>: DATABASE ACCESSION NUMBER: NCBI ACCESSION: NZ_SBLC01000077.1
  ref <309>: DATABASE ENTRY DATE: 2019-04-01
  ref <313>: RELEVANT RESIDUES IN SEQ ID NO: (1)..(1469)
caacttgagagtttgatcctggctcagaatgaacgctggcggcaggcctaacacatgcaagtcgaacgcatccttcggggtgagtggcggacgggtgagtaacacgtgggaacgtaccctttgctacggaatagtctcgggaaactgggggtaataccgtatgtgccctacgggggaaagatttatcggcaaaggatcggcccgcgttggattaggtagttggtggggtaatggcctaccaagccgacgatccatagctggtttgagaggatgaccagccacactgggactgagacacggcccagactcctacgggaggcagcagtggggaatcttagacaatgggggaaaccctgatctagccatgccgcgtgagtgatgaaggccttagggttgtaaagctctttcgctggggaagataatgacggtacccagtaaagaagccccggctaactccgtgccagcagccgcggtaatacggagggggctagcgttattcggaattactgggcgtaaagcgcacgtaggcggaccagaaagttaggggtgaaatcccggggctcaacctcggaactgcctctaaaactcctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaggcatgcctgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggaggggaccgttccagagatggttctttcacttcggtgacccctcacacaggtgctgcatggctgtcgtcagctcgtgtcgtgagatgttcggttaagtccggcaacgagcgcaacccacactttcagttgccagcattcagttgggcactctgaaagaactgccggtgataagccggaggaaggtgtggatgacgtcaagtcctcatggcccttacgggttgggctacacacgtgctacaatggcagtgacaatgggctaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacggccgtgcgctaaccagcaatggaggcagcggaccacggtaggctcagtgactggggtgaagtcgtaacaaggtagccgtaggggaacctgcggctggatcacctcctttctaa

SEQ ID NO: 4026 - DNA, 1470 bp, Gemmobacter megaterium
  ref <308>: DATABASE ACCESSION NUMBER: NCBI ACCESSION: NZ_FTOT01000028.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcctaacacatgcaagtcgagcgaggacttcggtcctagcggcggacgggtgagtaacgcgtgggaacgtaccctttgctacggaatagcctcgggaaactgggagtaataccgtatgtgccctttgggggaaagatttatcggcaaaggatcggcccgcgttggattaggtagttggtggggtaatggcctaccaagcctacgatccatagctggtttgagaggatgatcagccacactgggactgagacacggcccagactcctacgggaggcagcagtggggaatcttagacaatgggcgcaagcctgatctagccatgccgcgtgatcgatgaaggccttagggttgtaaagatctttcagctgggaagataatgacggtaccagcagaagaagccccggctaactccgtgccagcagccgcggtaatacggagggggctagcgttgttcggaattactgggcgtaaagcgcacgtaggcggattggaaagtcagaggtgaaatcccagggctcaaccttggaactgcctttgaaactatcagtctagaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggtagcatgctattcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggaggggaccgttccagagatggttctttctcgtaagagacccctcacacaggtgctgcatggctgtcgtcagctcgtgtcgtgagatgttcggttaagtccggcaacgagcgcaacccacactcttagttgccagcattcagttgggcactctaggagaactgccggtgataagccggaggaaggtgtggatgacgtcaagtcctcatggcccttacgggttgggctacacacgtgctacaatggtagtgacaatgggctaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgacgacgctgcgctaacccgcaagggaggcaggcggccacggtaggctcagcgactggggtgaagtcgtaacaaggtagccgtaggggaacctgcggctggatcacctcctttctaa

SEQ ID NO: 4027 - DNA, 1470 bp, Gemmobacter nectariphilus
  ref <308>: DATABASE ACCESSION NUMBER: NCBI ACCESSION: NZ_AUCM01000052.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcctaacacatgcaagtcgagcgcgcccttcggggtgagcggcggacgggtgagtaacgcgtgggaacgtgcccttctctacggaatagtctcgggaaactgggggtaataccgtatacgctcttcggaggaaagatttatcggagaaggatcggcccgcgttggattaggtagttggtgaggtaacggctcaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggatcagaaagtcagaggtgaaatcccagggctcaaccttggaactgcctttgaaactcctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggaggggaccgttccagagatggttctttctcgtaagagacccctcgcacaggtgctgcatggctgtcgtcagctcgtgtcgtgagatgttcggttaagtccggcaacgagcgcaacccacactcctggttgccagcattcagttgggcactttaggagaactgccggtgataagccggaggaaggtgtggatgacgtcaagtcctcatggcccttacgggttgggctacacacgtgctacaatggtggtgacaatgggccaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgctaacccgcaagggaggcagccggccacggtaggctcagtgactggggtgaagtcgtaacaaggtagccgtaggggaacctgcggctggatcacctcctttctaa

SEQ ID NO: 4028 - DNA, 1469 bp, Gemmobacter sp. HYN0069
  ref <308>: DATABASE ACCESSION NUMBER: NCBI ACCESSION: NZ_CP028918.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcgagaccttcgggtctagcggcggacgggtgagtaacgcgtgggaatatgcccttcggttcggaatagccccgggaaactgggagtaataccggatacggtctacggacgaaagatttatcgccgaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagcggggaagataatgactgtacccgcagaagaagccccggctaactccgtgccagcagccgcggtaatacggagggggctagcgttgttcggaattactgggcgtaaagcgcacgtaggcggactggaaagtcagaggtgaaatcccagggctcaaccttggaactgcctttgaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggtagcatgctattcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcagtgaccgttccagagatggttctttctcgtaagagacactgcacacaggtgctgcatggctgtcgtcagctcgtgtcgtgagatgttcggttaagtccggcaacgagcgcaacccacactcttagttgccagcattcagttgggcactctaggagaactgccggtgataagccggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattggttctacccgaaggtggtgcgccaaccagcaatggaggcagccaaccacggtaggatcagtgactggggtgaagtcgtaacaaggtagccgtaggggaacctgcggctggatcacctcctttctaa

SEQ ID NO: 4029 - DNA, 1470 bp, Gemmobacter sp. LW-1
  ref <308>: DATABASE ACCESSION NUMBER: NCBI ACCESSION: NZ_LJSC01000026.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcctaacacatgcaagtcgagcgaggacttcggtcctagcggcggacgggtgagtaacgcgtgggaacgtgccctttggttcggaatagccccgggaaactgggagtaataccggataagccctacgggggaaagatttatcgccaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgactgtaccagcagaagaagccccggctaactccgtgccagcagccgcggtaatacggagggggctagcgttgttcggaattactgggcgtaaagcgcacgtaggcggactggaaagttgggggtgaaatcccggggctcaacctcggaactgccttcaaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggcagtgaccgttccagagatggtcctttctcgcaagagacactgcacacaggtgctgcatggctgtcgtcagctcgtgtcgtgagatgttcggttaagtccggcaacgagcgcaacccacgcctttagttgccagcattcagttgggcactctaaaggaactgccggtgataagccggaggaaggtgtggatgacgtcaagtcctcatggcccttacgggttgggctacacacgtgctacaatggtggtgacaatgggttaatcccaaaaagccatctcagttcggattgtcgtctgcaactcggcggcatgaagtcggaatcgctagtaatcgcgtaacagcatgacgcggtgaatacgttcccgggccttgtacacaccgcccgtcacaccatgggaattggatccacccgaaggcggtgcgccaaccagcaatggaggcagccgaccacggtgggttcagtgactggggtgaagtcgtaacaaggtagccgtaggggaacctgcggctggatcacctcctttctaa

SEQ ID NO: 4030 - DNA, 1469 bp, Gemmobacter sp. YJ-T1-11
  ref <308>: DATABASE ACCESSION NUMBER: NCBI ACCESSION: NZ_QXXQ01000038.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgaacgaagccttcgggcttagtggcggacgggtgagtaacgcgtgggaacgtgccctttggttcggaatagccccgggaaactgggagtaataccggataagccctacgggggaaagatttatcgccaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgatcgatgaaggccttagggttgtaaagatctttcagctgggaagataatgactgtaccagcagaagaagccccggctaactccgtgccagcagccgcggtaatacggagggggctagcgttgttcggaattactgggcgtaaagcgcacgtaggcggaacagaaagtcagaggtgaaatcccagggctcaaccttggaactgcctttgaaactcctgttcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggcagtgaccgttccagagatggtcctttctcgcaagagacactgcacacaggtgctgcatggctgtcgtcagctcgtgtcgtgagatgttcggttaagtccggcaacgagcgcaacccacgcctttagttgccagcattcagttgggcactctaaaggaactgccggtgataagccggaggaaggtgtggatgacgtcaagtcctcatggcccttacgggttgggctacacacgtgctacaatggtggtgacaatgggttaatcccaaaaagccatctcagttcggattgtcgtctgcaactcggcggcatgaagtcggaatcgctagtaatcgcgtaacagcatgacgcggtgaatacgttcccgggccttgtacacaccgcccgtcacaccatgggaattggatccacccgaaggcggtgcgccaaccagcaatggaggcagccgaccacggtgggttcagtgactggggtgaagtcgtaacaaggtagccgtaggggaacctgcggctggatcacctcctttctaa

SEQ ID NO: 4031 - DNA, 1563 bp, Geoalkalibacter ferrihydriticus
  ref <308>: DATABASE ACCESSION NUMBER: NCBI ACCESSION: NZ_FNGU01000001.1
  ref <309>: DATABASE ENTRY DATE: 2019-04-01
  ref <313>: RELEVANT RESIDUES IN SEQ ID NO: (1)..(1563)
taactggagagtttgatcctggctcagaacgaacgctggcggcgtgcctaacacatgcaagtcgaacggtaacaggcccttcggggcgctgacgagtggcgcacgggtgagtaacacgtgggtaatctgcccaggggaccgggataacacttcgaaaggagtgctaataccggataagcccacgagctcttcggagcacgcgggaaaaggtggggatcttcggacctgccgtctctggatgagcccgcggcccattagctagttggcggggtaatggcccaccaaggcgacgatgggtagctggtctgagaggatgatcagccacactggaactgagacacggtccagactcctacgggaggcagcagtggggaattttgcgcaatgggcgaaagcctgacgcagcaacgccgcgtgagggatgaaggccttcgggtcgtaaacctctgtcagaggggaagaaccgccggtgggataataccccatcggtctgacggtaccctcagaggaagcaccggctaactccgtgccagcagccgcggtaatacggagggtgcaagcgttgttcggaattattgggcgtaaagcgcgtgcaggcggctgcgcaagtctgatgtgaaagccccgggctcaacctgggaagtgcatcggaaactgcgtagcttgagtacgggagagggaagcggaattccgagtgtaggggtgaaatccgtagatattcggaggaacaccagtggcgaaggcggcttcctggaccgatactgacgctgagacgcgaaagcgtggggagcaaacaggattagataccctggtagtccacgccgtaaacgatgggtactaggtgtcgcgggtattgacccctgcggtgccgaagctaacgcattaagtaccccgcctggggagtacggccgcaaggctaaaactcaaaggaattgacgggggcccgcacaagcggtggagcatgtggtttaattcgacgcaacgcgaagaaccttacctgggtttgacatcccgatcgtacctcctagagataggagggtcagttcggctggatcggtgacaggtgctgcatggctgtcgtcagctcgtgtcgtgagatgttgggttaagtcccgcaacgagcgcaaccctcgtccttagttgccagcattaagttgggcactctaaggagactgccggtgttaagccggaggaaggtggggatgacgtcaagtcctcatggcccttatgtccagggctacacacgtgctacaatggccggtacaaagggttgccaatccgcaaggtggagccaatcccagaaagccggtctcagttcggattggagtctgcaactcgactccatgaagttggaatcgctagtaatcgcgtatcagcatgacgcggtgaatacgttcccgggccttgtacacaccgcccgtcacaccacggaagttgtttgtacctgaagccggtgggctaacccgcaagggatgcagccgtccatggtatgaatggtaactggggtgaagtcgtaacaaggtagccgtaggggaacctgcggctggatcacctcctttctaa

SEQ ID NO: 4032 - DNA, 1566 bp, Geoalkalibacter subterraneus
  ref <308>: DATABASE ACCESSION NUMBER: NCBI ACCESSION: NZ_CP010311.1
  ref <309>: DATABASE ENTRY DATE: 2019-04-01
  ref <313>: RELEVANT RESIDUES IN SEQ ID NO: (1)..(1566)
taaactggagagtttgatcctggctcagaacgaacgctggcggcgtgcctaacacatgcaagtcgaacgagaaaggggacttcggtccctgagtacagtggcgcacgggtgagtaacacgtgggtaatctgcccggagattcgggacaacatctcgaaaggggtgctaataccggataagcctacgacgtcttcggacgacgcaggaaaaggtggggattcttcggaacctaccgtccccggatgagcccgcggcccattagctagttggcggggtaatggcccaccaaggcgacgatgggtagctggtctgagaggatgatcagccacactggaactgagacacggtccagactcctacgggaggcagcagtggggaattttgcgcaatgggcgaaagcctgacgcagcaacgccgcgtgagggatgaaggccttcgggtcgtaaacctctgtcagaggggaagaaccgtctgtgggataataccccgcaggcctgacggtaccctcagaggaagcaccggctaactccgtgccagcagccgcggtaatacggagggtgcaagcgttgttcggaattattgggcgtaaagcgcgcgcaggcggctgcgcaagtctgatgtgaaagccccgggctcaacctgggaagtgcatcggaaactgcgtagcttgagtacgggagagggaagcggaattccgagtgtaggggtgaaatccgtagatattcggaagaacaccagtggcgaaggcggcttcctggaccgatactgacgctgaggcgcgaaagcgtggggagcaaacaggattagataccctggtagtccacgccgtaaacgatgggtactaggtgtcgcgggtattgacccctgcggtgccgaagctaacgcattaagtaccccgcctggggagtacggccgcaaggctaaaactcaaaggaattgacgggggcccgcacaagcggtggagcatgtggtttaattcgacgcaacgcgaagaaccttacctgggtttgacatcccgatcgcaccctttagagatagaggggtcagttcggctggatcggagacaggtgctgcatggctgtcgtcagctcgtgtcgtgagatgttgggttaagtcccgcaacgagcgcaaccctcgtccttagttgccagcattgagttgggcactctaaggagactgccggtgttaaaccggaggaaggtggggatgacgtcaagtcctcatggcccttatgtccagggctacacacgtgctacaatggccggtacaaagggttgccaagccgcaaggtggagctaatcccaaaaagccggtctcagttcggattggagtctgcaactcgactccatgaagctggaatcgctagtaatcgcgtatcagcatgacgcggtgaatacgttcccgggccttgtacacaccgcccgtcacaccacggaagtcgtttgtacctgaagccggtgggctaaccctttaaggggagcagccgtccatggtatgaatggtaactggggtgaagtcgtaacaaggtagccgtaggggaacctgcggctggatcacctcctttct

SEQ ID NO: 4033 - DNA, 1565 bp, Geobacillus genomosp. 3
  ref <308>: DATABASE ACCESSION NUMBER: NCBI ACCESSION: NC_022080.4
  ref <309>: DATABASE ENTRY DATE: 2019-04-01
  ref <313>: RELEVANT RESIDUES IN SEQ ID NO: (1)..(1565)
tcttttggagagtttgatcctggctcaggacgaacgctggcggcgtgcctaatacatgcaagtcgagcggaccggatcagggcttgccttgattcggtcagcggcggacgggtgagtaacacgtgggcaacctgcccgcaagaccgggataactccgggaaaccggagctaataccggataacaccgaagaccgcatgatcttcggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggccttcgggtcgtaaagctctgttgtgagggacgaaggagcgccgtttgaacaaggcggcgcggtgacggtacctcacgagaaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggggacagggtgacaggtggtgcatggttgtcgtcagctcgtgtcgtgagatgttgggttaagtcccgcaacgagcgcaacccttgcctctagttgccagcattcaggtgggcactctagagggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttctaa

SEQ ID NO: 4034 - DNA, 1567 bp, Geobacillus jurassicus
  ref <308>: DATABASE ACCESSION NUMBER: NCBI ACCESSION: NZ_BCQG01000022.1
  ref <309>: DATABASE ENTRY DATE: 2019-04-01
  ref <313>: RELEVANT RESIDUES IN SEQ ID NO: (1)..(1567)
ttctttggagagtttgatcctggctcaggacgaacgctggcggcgtgcctaatacatgcaagtcgagcggaccgaatgggagcttgctcttgttcggtcagcggcggacgggtgagtaacacgtgggcaacctgcccgcaagaccgggataactccgggaaaccggagctaataccggataacaccgaagaccgcatggtctttggttgaaaggcggcgcaagctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgtttgaagaaggcggcgcggtgacggtacctcacgaggaagccccggctaactacgtgccagcagccgcggtaatacgtagggggcgagcgttgtccggaattattgggcgtaaagcgcgcgcaggcggccccttaagtctgatgtgaaagcccacggctcaaccgtggagggtcattggaaactggggggcttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttccccccccttcgagggggacagggtgacaggtggtgcatggttgtcgtcagctcgtgtcgtgagatgttgggttaagtcccgcaacgagcgcaaccctcgcctctagttgccagcattggggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaaccccctaagggagccagccgccgaaggtggggcaagtgattggggtgaagtcgtaacaaggtagccgtaccggaaggtgcggctggatcacctcctttctaa

SEQ ID NO: 4035 - DNA, 1564 bp, Geobacillus kaustophilus
  ref <308>: DATABASE ACCESSION NUMBER: NCBI ACCESSION: NZ_JYBP01000003.1
  ref <309>: DATABASE ENTRY DATE: 2019-04-01
  ref <313>: RELEVANT RESIDUES IN SEQ ID NO: (1)..(1564)
ttctttggagagtttgatcctggctcaggacgaacgctggcggcgtgcctaatacatgcaagtcgagcggaccgaatgggagcttgctcttgttcggtcagcggcggacgggtgagtaacacgtgggcaacctgcccgcaagaccgggataactccgggaaaccggagctaataccggataacaccgaagaccgcatggtcttgggttgaaaggcggcgcaagctgccacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggggagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcgggggggacagggtgacaggtggtgcatggttgtcgtcagctcgtgtcgtgagatgttgggttaagtcccgcaacgagcgcaaccctcgcctctagttgccagcattcggttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgtttcgggagccagccgccgaaggtggggcaagtgattggggtgaagtcgtaacaaggtagccgtaccggaaggtgcggctggatcacctcctttctaa

SEQ ID NO: 4036 - DNA, 930 bp, Geobacillus sp. 1017
  ref <308>: DATABASE ACCESSION NUMBER: NCBI ACCESSION: NZ_MQMG01000129.1
  ref <309>: DATABASE ENTRY DATE: 2019-04-01
  ref <313>: RELEVANT RESIDUES IN SEQ ID NO: (1)..(930)
ggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattc

SEQ ID NO: 4037 - DNA, 1375 bp, Geobacillus sp. 44B
  ref <308>: DATABASE ACCESSION NUMBER: NCBI ACCESSION: NZ_NADP01000242.1
  ref <309>: DATABASE ENTRY DATE: 2019-04-01
  ref <313>: RELEVANT RESIDUES IN SEQ ID NO: (1)..(1375)
aagaccgcatggtctttggttgaaaggcggcttcggctgtcacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggycattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggtcaaaccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcccccttcggggggacagggtgacaggtggtgcatggttgtcgtcagctcgtgtcgtgagatgttgggttaagtcccgcaacgagcgcaaccctcgcccctagttgccagcattcagttgggcactctagggggactgccggtgacaaaccggaggaaggtggggatgacgtcaaatcatcatgccccttatgacctgggctacacacgtgctacaatgggcggtacaaagggctgcgaacccgcgagggggagccaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttctaa

SEQ ID NO: 4038 - DNA, 1358 bp, Geobacillus sp. 44C
  ref <308>: DATABASE ACCESSION NUMBER: NCBI ACCESSION: NZ_NADQ01000114.1
  ref <309>: DATABASE ENTRY DATE: 2019-04-01
  ref <313>: RELEVANT RESIDUES IN SEQ ID NO: (1)..(1358)
ggttgaaaggtggcttttgctaccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttttccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcccccttcggggggacagggtgacaggtggtgcatggttgtcgtcagctcgtgtcgtgagatgttgggttaagtcccgcaacgagcgcaaccctcgcccctagttgccagcattcagttgggcactctagggggactgccggtgacaaaycggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaaccctttaagggagccagccgccgaaggtggggcaagtgattggggtgaagtcgtaacaaggtagccgtaccggaaggtgcggctggatcacctcctttctaa

SEQ ID NO: 4039 - DNA, 1430 bp, Geobacillus sp. 46C-IIa
  ref <308>: DATABASE ACCESSION NUMBER: NCBI ACCESSION: NZ_NADR01000044.1
  ref <309>: DATABASE ENTRY DATE: 2019-04-01
  ref <313>: RELEVANT RESIDUES IN SEQ ID NO: (1)..(1430)
agcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggccttcgggtcgtaaagctctgttgtgagggacgaaggagcgccgtttgaacaaggcggcgcggtgacggtacctcacgagaaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaacccttgcctctcgttgccagcattcagttgggcactctagagggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagaacgggagccagccgccgaaggtggggcaagtgattggggtgaagtcgtaacaaggtagccgtaccggaaggtgcggctggatcacctcctttctaa

SEQ ID NO: 4040 - DNA, 1464 bp, Geobacillus sp. 47C-IIb
  ref <308>: DATABASE ACCESSION NUMBER: NCBI ACCESSION: NZ_NADS01000144.1
  ref <309>: DATABASE ENTRY DATE: 2019-04-01
  ref <313>: RELEVANT RESIDUES IN SEQ ID NO: (1)..(1464)
cagcggcggacgggtgagtaacacgtgggcaacctgcccgcaagaccgggataactccgggaaaccggagctaataccggataacaccaaagaccgcatggtctttggttgaaaggcggcttcggctgycacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggccttcgggtcgtaaagctctgttgtgagggacgaaggagcgccgtttgaataaggcggygcggtgacggtacctcacgagaaagccccggctaactacgtgccagcagccgcggtaatacgtagggggcgagcgttgtccggaattattgggcgtaaagcgcgcgcaggcggtcctttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgagtgctaagtgttagaggggtcacaccctttagtgctgyagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaacccttgcctctagttgccagcattcagttgggcactctagagggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccttacgggagccagccgccgaaggtggggcaagtgattggggtgaagtcgtaacaaggtagccgtaccggaaggtgcggctggatcacctcctttctaa

SEQ ID NO: 4041 - DNA, 516 bp, Geobacillus sp. 8
  ref <308>: DATABASE ACCESSION NUMBER: NCBI ACCESSION: NZ_LVHY01000119.1
  ref <309>: DATABASE ENTRY DATE: 2019-04-01
  ref <313>: RELEVANT RESIDUES IN SEQ ID NO: (1)..(516)
ggggacagggtgacaggtggtgcatggttgtcgtcagctcgtgtcgtgagatgttgggttaagtcccgcaacgagcgcaacccttgaccttagttgccagcattcagttgggcactctaaggtgactgccggctaaaagtcggaggaaggtggggatgacgtcaaatcatcatgccccttatgacctgggctacacacgtgctacaatgggtggtacaaagggcagcgaaaccgcgaggtggagcgaatcccaaaaaaccactctcagttcggattgcaggctgcaactcgcctgcatgaagccggaatcgctagtaatcgcggatcagcatgccgcggtgaatacgttcccgggtcttgtacacaccgcccgtcacaccacgagagtttgtaacacccgaagtcggtggggtaacccttacgggagccagccgccgaaggtgggacaaatgattggggtgaagtcgtaacaaggtagccgtatcggaaggtgcggctggatcacctcctttctaa

SEQ ID NO: 4042 - DNA, 820 bp, Geobacillus sp. B4113 201601
  ref <308>: DATABASE ACCESSION NUMBER: NCBI ACCESSION: NZ_LQYX01000008.1
  ref <309>: DATABASE ENTRY DATE: 2019-04-01
  ref <313>: RELEVANT RESIDUES IN SEQ ID NO: (1)..(820)
cttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgtttgaacaaggcggcgcggtgacggtacctcacgagaaagccccggctaactacgtgccagcagccgcggtaatacgtagggggcgagcgttgtccggaattattgggcgtaaagcgcgcgcaggcggcttcttaagtctgatgtgaaagcccacggctcaaccgtggagggtcattggaaactggggagcttgagtgcaggagaggggagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgaccacccaagagattgggcgttcccccttcggggg

SEQ ID NO: 4043 - DNA, 1564 bp, Geobacillus sp. C56-T3
  ref <308>: DATABASE ACCESSION NUMBER: NCBI ACCESSION: NC_014206.1
  ref <309>: DATABASE ENTRY DATE: 2019-04-01
  ref <313>: RELEVANT RESIDUES IN SEQ ID NO: (1)..(1564)
tcttttggagagtttgatcctggctcaggacgaacgctggcggcgtgcctaatacatgcaagtcgagcggaccaaatcggagcttgctctgatttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagaaattgggcgttccccccttcggggggacagggtgacaggtggtgcatggttgtcgtcagctcgtgtcgtgagatgttgggttaagtcccgcaacgagcgcaaccctcgcctctagttgccagcattcagttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacctcctttctaa

SEQ ID NO: 4044 - DNA, 1563 bp, Geobacillus sp. CAMR5420
  ref <308>: DATABASE ACCESSION NUMBER: NCBI ACCESSION: NZ_JHUS01000002.1
  ref <309>: DATABASE ENTRY DATE: 2019-04-01
  ref <313>: RELEVANT RESIDUES IN SEQ ID NO: (1)..(1563)
ttctttggagagtttgatcctggctcaggacgaacgctggcggcgtgcctaatacatgcaagtcgagcggaccaaatcggagcttgctctgatttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttctaa

SEQ ID NO: 4045 - DNA, 1565 bp, Geobacillus sp. GHH01
  ref <308>: DATABASE ACCESSION NUMBER: NCBI ACCESSION: NC_020210.1
  ref <309>: DATABASE ENTRY DATE: 2019-04-01
  ref <313>: RELEVANT RESIDUES IN SEQ ID NO: (1)..(1565)
ttctttggagagtttgatcctggctcaggacgaacgctggcggcgtgcctaatacatgcaagtcgagcggaccggattggggcttgccttgattcggtcagcggcggacgggtgagtaacacgtgggcaacctgcccgcaagaccgggataactccgggaaaccggagctaataccggataacaccgaagaccgcatggtctttggttgaaaggcggcctttgggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcgggggggacagggtgacaggtggtgcatggttgtcgtcagctcgtgtcgtgagatgttgggttaagtcccgcaacgagcgcaaccctcgcctctagttgccagcattcggttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacctcctttctaa

SEQ ID NO: 4046 - DNA, 1563 bp, Geobacillus sp. LEMMY01
  ref <308>: DATABASE ACCESSION NUMBER: NCBI ACCESSION: NZ_MVKA01000013.1
  ref <309>: DATABASE ENTRY DATE: 2019-04-01
  ref <313>: RELEVANT RESIDUES IN SEQ ID NO: (1)..(1563)
tcttttggagagtttgatcctggctcaggacgaacgctggcggcgtgcctaatacatgcaagtcgagcggaccaaatcggagcttgctctgattcggtcagcggcggacgggtgagtaacacgtgggcaacctgcccgcaagaccgggataactccgggaaaccggagctaataccggataacaccgaagaccgcatggtcttcggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggtyccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctrcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcrgttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacctcctttctaa

SEQ ID NO: 4047 - DNA, 696 bp, Geobacillus sp. MAS1
  ref <308>: DATABASE ACCESSION NUMBER: NCBI ACCESSION: NZ_AYSF01000014.1
  ref <309>: DATABASE ENTRY DATE: 2019-04-01
  ref <313>: RELEVANT RESIDUES IN SEQ ID NO: (1)..(696)
ctgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtg

SEQ ID NO: 4048 - DNA, 1559 bp, Geobacillus sp. PA-3
  ref <308>: DATABASE ACCESSION NUMBER: NCBI ACCESSION: NZ_LIDX01000015.1
  ref <309>: DATABASE ENTRY DATE: 2019-04-01
  ref <313>: RELEVANT RESIDUES IN SEQ ID NO: (1)..(1559)
tttggagagtttgatcctggctcaggacgaacgctggcggcgtgcctaatacatgcaagtcgagcggaccgaacgagagcttgctcttgtttggtcagcggcggacgggtgagtaacacgtgggcaacctgcccgcaagaccgggataactccgggaaaccggagctaataccggataacaccaaagaccgcatggtctttggttgaaaggcggcttcggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggccttcgggtcgtaaagctctgttgtgagggacgaaggagcgccgtttgaataaggcggcgcggtgacggtacctcacgagaaagccccggctaactacgtgccagcagccgcggtaatacgtagggggcgagcgttgtccggaattattgggcgtaaagcgcgcgcaggcggtcctttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgtaactgacgctgaggcgcgaaagcgtggggagcaaacaggattagataccctggtagtccacgccgtaaacgatgagtgctaagtgttagaggggtcacaccctttagtgctgtagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaacccttgcctctagttgccagcattcagttgggcactctagagggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccttacgggagccagccgccgaaggtggggcaagtgattggggtgaagtcgtaacaaggtagccgtaccggaaggtgcggctggatcacctcctttctaa

SEQ ID NO: 4049 - DNA, 1564 bp, Geobacillus sp. Sah69
  ref <308>: DATABASE ACCESSION NUMBER: NCBI ACCESSION: NZ_LLKS01000031.1
  ref <309>: DATABASE ENTRY DATE: 2019-04-01
  ref <313>: RELEVANT RESIDUES IN SEQ ID NO: (1)..(1564)
ttctttggagagtttgatcctggctcaggacgaacgctggcggcgtgcctaatacatgcaagtcgagcggaccggattggggcttgccttgattcggtcagcggcggacgggtgagtaacacgtgggcaacctgcccgcaagaccgggataactccgggaaaccggagctaataccggataacaccgaagaccgcatggtcttcggttgaaaggcggcctttgggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcggttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttctaa

SEQ ID NO: 4050 - DNA, 906 bp, Geobacillus sp. T6
  ref <308>: DATABASE ACCESSION NUMBER: NCBI ACCESSION: NZ_LDNZ01000273.1
  ref <309>: DATABASE ENTRY DATE: 2019-04-01
  ref <313>: RELEVANT RESIDUES IN SEQ ID NO: (1)..(906)
ggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtggacggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggccccttaagtctgatgtgaaagcccacggctcaaccgtggagggtcattggaaactggggggcttgagggcaggagaggagagcggaattccaccgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccagg

SEQ ID NO: 4051 - DNA, 1563 bp, Geobacillus sp. WCH70
  ref <308>: DATABASE ACCESSION NUMBER: NCBI ACCESSION: NC_012793.1
  ref <309>: DATABASE ENTRY DATE: 2019-04-01
  ref <313>: RELEVANT RESIDUES IN SEQ ID NO: (1)..(1563)
ctttttggagagtttgatcctggctcaggacgaacgctggcggcgtgcctaatacatgcaagtcgagcggaccgaacggaagcttgcttctgttcggttagcggcggacgggtgagtaacacgtgggtaacctgcccgtaagaccgggataactccgggaaaccggggctaataccggataacaccgaagaccgcatggtctttggttgaaaggtggcttttgctaccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtaccgttcgaatagggcggtacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggattaaaccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcccccttcgggggggacagggtgacaggtggtgcatggttgtcgtcagctcgtgtcgtgagatgttgggttaagtcccgcaacgagcgcaaccctcgcccctagttgccagcattcagttgggcactctagggggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgtaagggagccagccgccgaaggtggggcaagtgattggggtgaagtcgtaacaaggtagccgtaccggaaggtgcggctggatcacctcctttctaa

SEQ ID NO: 4052 - DNA, 1564 bp, Geobacillus sp. Y4.1MC1
  ref <308>: DATABASE ACCESSION NUMBER: NCBI ACCESSION: NC_014650.1
  ref <309>: DATABASE ENTRY DATE: 2019-04-01
  ref <313>: RELEVANT RESIDUES IN SEQ ID NO: (1)..(1564)
ctttttggagagtttgatcctggctcaggacgaacgctggcggcgtgcctaatacatgcaagtcgagcggaccgggcgggagcttgcttccgcctggttagcggcggacgggtgagtaacacgtgggtaacctgcccgtaagactgggataactccgggaaaccggggctaataccggataacaccgaagaccgcatggtcttcggttgaaaggcggcttcggctgccacttacggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatggacgaaagtctgacggagcgacgccgcgtgagcgaagaaggtcttcggatcgtaaagctctgttgttagggaagaagaagtgccgttcgaacagggcggcacggtgacggtacctaacgagaaagccccggctaactacgtgccagcagccgcggtaatacgtagggggcgagcgttgtccggaattattgggcgtaaagcgcgcgcaggcggtcccttaagtctgatgtgaaagcccacggcttaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagaggggttattccctttagtgctgtagctaacgcgttaagcactccgcctggggagtacggccgcaaggctgaaactcaaaggaattgacgggggcccgcacaagcggtggagcatgtggtttaattcgaagcaacgcgaagaaccttaccaggtcttgacatcccctgacaaccctggagacagggcgttcctcccttgcgggaggacagggtgacaggtggtgcatggttgtcgtcagctcgtgtcgtgagatgttgggttaagtcccgcaacgagcgcaaccctcgcccctagttgccagcattcagttgggcactctagggggactgccggctaaaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttctaa

SEQ ID NO: 4053 - DNA, 1563 bp, Geobacillus sp. Y412MC52
  ref <308>: DATABASE ACCESSION NUMBER: NCBI ACCESSION: NC_014915.1
  ref <309>: DATABASE ENTRY DATE: 2019-04-01
  ref <313>: RELEVANT RESIDUES IN SEQ ID NO: (1)..(1563)
tcttttggagagtttgatcctggctcaggacgaacgctggcggcgtgcctaatacatgcaagtcgagcggaccggatcggagcttgctctggtttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggggcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggtcccttaagtctgatgtgaaagcccacggctcaaccatggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcattcagttgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggcaacccgcaagggagccagccgccgaaggtggggcaagtgattggggtgaagtcgtaacaaggtagccgtaccggaaggtgcggctggatcacctcctttctaa

SEQ ID NO: 4054 - DNA, 1563 bp, Geobacillus sp. Y412MC61; identical to SEQ ID NO: 4053
  ref <308>: DATABASE ACCESSION NUMBER: NCBI ACCESSION: NC_013411.1
  ref <309>: DATABASE ENTRY DATE: 2019-04-01
  ref <313>: RELEVANT RESIDUES IN SEQ ID NO: (1)..(1563)

SEQ ID NO: 4055 - DNA, 200 bp, Geobacillus subterraneus
  ref <308>: DATABASE ACCESSION NUMBER: NCBI ACCESSION: NZ_LWHE01000113.1
  ref <309>: DATABASE ENTRY DATE: 2019-04-01
  ref <313>: RELEVANT RESIDUES IN SEQ ID NO: (1)..(200)
cgcggatcagcatgccgcggtgaatacgttcccgggccttgtacacaccgcccgtcacaccacgagagcttgcaacacccgaagtcggtgaggtaacccgcaagggagccagccgccgaaggtggggcaagtgattggggtgaagtcgtaacaaggtagccgtaccggaaggtgcggctggatcacctcctttctaagga

SEQ ID NO: 4056 - DNA, 1565 bp, Geobacillus vulcani
  ref <308>: DATABASE ACCESSION NUMBER: NCBI ACCESSION: NZ_JPOI01000001.1
  ref <309>: DATABASE ENTRY DATE: 2019-04-01
  ref <313>: RELEVANT RESIDUES IN SEQ ID NO: (1)..(1565)
ttctttggagagtttgatcctggctcaggacgaacgctggcggcgtgcctaatacatgcaagtcgagcggaccgaatcggagcttgctctggtttggtcagcggcggacgggtgagtaacacgtgggcaacctgcccgcaagaccgggataactccgggaaaccggggctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgagaaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggggacagggtgacaggtggtgcatggttgtcgtcagctcgtgtcgtgagatgttgggttaagtcccgcaacgagcgcacccctcgcctctagttgccagcacggaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgaggtaacccttacgggagccagccgccgaaggtggggcaagtgattggggtgaagtcgtaacaaggtagccgtaccggaaggtgcggctggatcacctcctttctaa

SEQ ID NO: 4057 - DNA, 1560 bp, Geobacter anodireducens
  ref <308>: DATABASE ACCESSION NUMBER: NCBI ACCESSION: NZ_CP014963.1
  ref <309>: DATABASE ENTRY DATE: 2019-04-01
  ref <313>: RELEVANT RESIDUES IN SEQ ID NO: (1)..(1560)
aaactggagagtttgatcctggctcagaacgaacgctggcggcgtgcctaacacatgcaagtcgaacgtgatccgcccttcggggtggtgaaagtggcgcacgggtgagtaacgcgtggataatctgcccgaggatttgggataacatctcgaaaggggtgctaataccgaataagccacggggtctacggatcttgcgggaaaagggggggaccttcgggcctcctgtccttggatgagtctgcgtaccattagctagttggtggggtaatggcctaccaaggcgacgatggttagctggtctgagaggatgatcagccacactggaactgagacacggtccagactcctacgggaggcagcagtggggaattttgcgcaatgggggaaaccctgacgcagcaacgccgcgtgggtgatgaaggccttcgggtcgtaaagctctgtctggagggaagaaatgattgggagctaatacctcttgatcttgacggtacctctgaaggaagcaccggctaactccgtgccagcagccgcggtaatacggagggtgcaagcgttgttcggaattattgggcgtaaagcgcgtgtaggcggtcttttaagtctgatgtgaaagccccgggctcaacctgggaagtgcattggaaactgggaggcttgagtacgggagaggagagtggaattcctagtgtaggagtgaaatccgtagatattaggaggaacaccggtggcgaaggcggctctctggaccgatactgacgctgagacgcgaaagcgtgggtagcaaacaggattagataccctggtagtccacgccgtaaacgatgagtactaggtgttgcgggtattgacccctgcagtgccgtagctaacgcattaagtactccgcctgggaagtacggtcgcaagactaaaactcaaaggaattgacgggggcccgcacaagcggtggagcatgtggtttaattcgacgcaacgcgcagaaccttacctgggcttgacatccacggaaccctcccgaaacggaggggtgcccttcggggagccgtgagacaggtgctgcatggctgtcgtcagctcgtgtcgtgagatgttgggttaagtcccgcaacgagcgcaacccttgtcatcagttgccatcattcagttgggcactctgatgaaactgccggtgtcaaaccggaggaaggtggggatgacgtcaagtcctcatggcccttatgtccagggctacacacgtgctacaatggccggtacaaagagtagcaataccgcgaggtggagccaatctcagaaagccggtctcagttcggattggagtctgcaactcgactccatgaagtcggaatcgctagtaatcgcggatcagcatgccgcggtgaatacgttcccgggccttgtacacaccgcccgtcacaccacgggagtcgactggtcccgaagtgcgtgagctaaccccttgtgggaggcagcgtcctaaggaatggtcggtgactggggtgaagtcgtaacaaggtagccgtaggggaacctgcggctggatcacctcctttctaa

SEQ ID NO: 4058 - DNA, 1561 bp, Geobacter bemidjiensis
  ref <308>: DATABASE ACCESSION NUMBER: NCBI ACCESSION: NC_011146.1
  ref <309>: DATABASE ENTRY DATE: 2019-04-01
  ref <313>: RELEVANT RESIDUES IN SEQ ID NO: (1)..(1561)
ttaaactggagagtttgatcctggctcagaacgaacgctggcggcgtgcttaacacatgcaagtcgaacgggatccagagcttgctctggtgagagtggcgcacgggtgagtaacgcgtggataacctgccctggtatctggaataacatctcgaaaggggtgctaataccggataagcctacggagccttcggtctctgcaggaaaaggtggcctctatttataagctaccgtatcaggatgggtccgcgtaccattagctagttggtagggtaatggcctaccaaggctacgatggttagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtcagtagggaagaaatgaaaacggttaatacccgtttttcttgacggtacctacaaaggaagcaccggctaactccgtgccagcagccgcggtaatacggagggtgcaagcgttgttcggatttattgggcgtaaagcgcgtgtaggcggtttcttaagtctgatgtgaaagccctgggctcaacccaggaagtgcattggatactgggagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagaactaggtgttgcgggtattgacccctgcagtgccgcagctaacgcattaagttctccgcctgggaagtacggtcgcaagactaaaactcaaaggaattgacgggggcccgcacaagcggtggagcatgtggtttaattcgacgcaacgcgcagaaccttacctgggcttgacatctgcggaacctccccgaaacgggagggtgccttcgggagccgcaagacaggtgctgcatggctgtcgtcagctcgtgtcgtgagatgttgggttaagtcccgcaacgagcgcaacccctatccttagttgccatcatttagttgggcactctaaggagactgccggtgtcaaaccggaggaaggtggggatgacgtcaagtcctcatggcccttatgtccagggctacacacgtgctacaatggccggtacaaagagcagcgataccgcgaggtggagccaatctcaaaaagccggtctcagttcggattggagtctgcaactcgactccatgaagttggaatcgctagtaatcgcggatcagcacgccgcggtgaatacgttcccgggccttgtacacaccgcccgtcacaccacgggagtcggttggtcccgaagtgcgtgagctaacccgcaagggaggcagcgtcctaaggaatggccggtgactggggtgaagtcgtaacaaggtagccgtaggggaacctgcggctggatcacctcctttctaa

SEQ ID NO: 4059 - DNA, 1561 bp, Geobacter bremensis
  ref <308>: DATABASE ACCESSION NUMBER: NCBI ACCESSION: NZ_AUGE01000077.1
  ref <309>: DATABASE ENTRY DATE: 2019-04-01
  ref <313>: RELEVANT RESIDUES IN SEQ ID NO: (1)..(1561)
ttaaactggagagtttgatcctggctcagaacgaacgctggcggcgtgcttaacacatgcaagtcgaacgggatccagagcttgctctggtgagagtggcgcacgggtgagtaacgcgtggataacctgccctggtatctggaataacatctcgaaaggggtgctaataccggataagcctacggagccttcggtctctgcaggaaaaggtggcctctatttataagctaccgtatcgggatgggtccgcgtaccattagctagttggtggggtaatggcccaccaaggcgacgatggttagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtcagaagggaagaaatggagcgtgctaatatcacgttttcttgacggtaccttcaaaggaagcaccggctaactccgtgccagcagccgcggtaatacggagggtgcaagcgttgttcggatttattgggcgtaaagcgcgtgtaggcggtttcttaagtctgatgtgaaagccctgggctcaacccaggaagtgcattggatactgggagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagaactaggtgttgcgggtattgacccctgcagtgccgcagctaacgcattaagttctccgcctgggaagtacggtcgcaagactaaaactcaaaggaattgacgggggcccgcacaagcggtggagcatgtggtttaattcgacgcaacgcgcagaaccttacctgggcttgacatctgcggaacctccccgaaacgggagggtgccttcgggagccgcaagacaggtgctgcatggctgtcgtcagctcgtgtcgtgagatgttgggttaagtcccgcaacgagcgcaacccctatccttagttgccatcatttagttgggcactctaaggagactgccggtgtcaaaccggaggaaggtggggatgacgtcaagtcctcatggcccttatgtccagggctacacacgtgctacaatggccggtacaaagagcagcgataccgcgaggtggagccaatctcaaaaagccggtctcagttcggattggagtctgcaactcgactccatgaagttggaatcgctagtaatcgcggatcagcatgccgcggtgaatacgttcccgggccttgtacacaccgcccgtcacaccacgggagtcggttggtcccgaagtgcgtgagctaacccgcaagggaggcagcgtcctaaggaatggccggtgactggggtgaagtcgtaacaaggtagccgtaggggaacctgcggctggatcacctcctttctaa

SEQ ID NO: 4060 - DNA, 1560 bp, Geobacter daltonii
  ref <308>: DATABASE ACCESSION NUMBER: NCBI ACCESSION: NC_011979.1
  ref <309>: DATABASE ENTRY DATE: 2019-04-01
  ref <313>: RELEVANT RESIDUES IN SEQ ID NO: (1)..(1560)
ttaaactggagagtttgatcctggctcagaacgaacgctggcggcgtgcttaacacatgcaagtcgaacggaattaggggcttgctcctaatttagtggcgcacgggtgagtaacgcgtggataacctaccctggtatctgggataacatctcgaaaggggtgctaataccggataagcccacgggaactttggttcttgcgggaaaaggtggcctctatttataagctactgtatcaggatgggtccgcgtaccattagctagttggtagtgtaatggactaccaaggctacgatggttagctggtctgagaggatgatcagccacactggaactgagacacggtccagactcctacgggaggcagcagtggggaattttgcgcaatgggggaaaccctgacgcagcaacgccgcgtgagtgatgaaggccttcgggtcgtaaagctctgtcagaggggaagaagtgtatgggcgctaataccatctatacttgacggtaccctcaaaggaagcaccggctaactccgtgccagcagccgcggtaatacggagggtgcaagcgttgttcggatttattgggcgtaaagcgcgtgtaggcggtcttttaagtctgatgtgaaagccccgggctcaacccgggaagtgcattggaaactgggagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagtactaggtgttgcgggtattgacccctgcagtgccgcagctaacgcattaagtactccgcctgggaagtacggtcgcaagactaaaactcaaaggaattgacgggggcccgcacaagcggtggagcatgtggtttaattcgacgcaacgcgcagaaccttacctgggcttgacatctgcggaacctggtggaaacatcggggtgccttcgggagccgcaagacaggtgctgcatggctgtcgtcagctcgtgtcgtgagatgttgggttaagtcccgcaacgagcgcaacccctgtccttagttgccatcattcagttgggcactctaaggagactgccggtgttaaaccggaggaaggtggggatgacgtcaagtcctcatggcccttatgtccagggctacacacgtgctacaatggccggtacaaagagttgcgatgccgcgaggtggagctaatctcaaaaaaccggtctcagttcggattggagtctgcaactcgactccatgaagttggaatcgctagtaatcgcggatcagcatgccgcggtgaatacgttcccgggccttgtacacaccgcccgtcacaccacgggagtcgattggtcccgaagtgcgtgagctaacccgcaagggaggcagcgtcctaaggaatggtcggtgactggggtgaagtcgtaacaaggtagccgtaggggaacctgcggctggatcacctcctttct

SEQ ID NO: 4061 - DNA, 1562 bp, Geobacter lovleyi
  ref <308>: DATABASE ACCESSION NUMBER: NCBI ACCESSION: NC_010814.1
  ref <309>: DATABASE ENTRY DATE: 2019-04-01
  ref <313>: RELEVANT RESIDUES IN SEQ ID NO: (1)..(1562)
aaactggagagtttgatcctggctcagaacgaacgctggcggcgtgcctaacacatgcaagtcgaacggagtgaaggagcttgctctttcatttagtggcgcacgggtgagtaacgcgtagataatctgccttggactctgggataacatctcgaaaggggtgctaataccggataagcccacgatggcgtaagtcattgcgggaaaagggggcctctgaatatgctcctgattcaagatgagtctgcgtaccattagctagttggtagggtaagagcctaccaaggcgacgatggttagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtctagagggaagaaatgatagtcggttaatacccggttttcttgacggtacctctgaaggaagcaccggctaactccgtgccagcagccgcggtaatacggagggtgcaagcgttgttcggatttattgggcgtaaagcgcgtgtaggcggtttgttaagtctgatgtgaaagccctgggctcaacctgggaagtgcattggaaactggcagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagtactaggtgttgcgggtattgacccctgcagtgccgcagctaacgcattaagtactccgcctgggaagtacggtcgcaagactaaaactcaaaggaattgacgggggcccgcacaagcggtggagcatgtggtttaattcgacgcaacgcgcagaaccttacctggtcttgacatctacggaacctctatgaaagtagagggtgcctttcggggagccgtaagacaggtgctgcatggctgtcgtcagctcgtgtcgtgagatgttgggttaagtcccgcaacgagcgcaacccctatcctcagttgccatcattaagttgggcactctgtggagactgccggtgtcaaaccggaggaaggtggggatgacgtcaagtcctcatggcccttatgaccagggctacacacgtgctacaatggccggtacaaagagttgcgatgccgcgaggtggagctaatctcataaagccggtctcagttcggattggagtctgcaactcgactccatgaagttggaatcgctagtaatcgcggatcagcatgccgcggtgaatacgttcccgggccttgtacacaccgcccgtcacaccacgggagtcgattggtcccgaagtacgtgagctaacccttttgggaggcagcgtcctaaggaatggtcggtgactggggtgaagtcgtaacaaggtagccgtaggggaacctgcggctggatcacctcctttctaa

SEQ ID NO: 4062 - DNA, 1558 bp, Geobacter metallireducens
  ref <308>: DATABASE ACCESSION NUMBER: NCBI ACCESSION: NZ_AGJM01000068.1
  ref <309>: DATABASE ENTRY DATE: 2019-04-01
  ref <313>: RELEVANT RESIDUES IN SEQ ID NO: (1)..(1558)
aaactggagagtttgatcctggctcagaacgaacgctggcggcgtgcctaacacatgcaagtcgaacgtgaagggggcttcggtccccggaaagtggcgcacgggtgagtaacgcgtggataatctgcccagtgatctgggataacatctcgaaaggggtgctaataccggataagcccacggagtccttggattctgcgggaaaagggggggaccttcgggccttttgtcactggatgagtccgcgtaccattagctagttggtggggtaatggcccaccaaggctacgatggttagctggtctgagaggatgatcagccacactggaactgagacacggtccagactcctacgggaggcagcagtggggaattttgcgcaatgggcgaaagcctgacgcagcaacgccgcgtgagtgatgaaggccctcgggtcgtaaagctctgtcgggagggaagaagtgattgagggttaataccccttggtcttgacggtacctccgaaggaagcaccggctaactccgtgccagcagccgcggtaatacggagggtgcaagcgttgttcggaattattgggcgtaaagcgcgtgtaggcggtttcttaagtctgatgtgaaagccccgggctcaacctgggaagtgcattggaaactgggagacttgagtacgggagagggtagtggaattcctagtgtaggagtgaaatccgtagatattaggaggaacaccggtggcgaaggcggctacctggaccgatactgacgctgagacgcgaaagcgtggggagcaaacaggattagataccctggtagtccacgccgtaaacgatgagtactaggtgttgcgggtattgacccctgcagtgccgcagctaacgcattaagtactccgcctgggaagtacggccgcaaggctaaaactcaaaggaattgacgggggcccgcacaagcggtggagcatgtggtttaattcgacgcaacgcgcagaaccttacctgggcttgacatccgcggaacctctatgaaagtagggggtgcccttcggggagccgcgagacaggtgctgcatggctgtcgtcagctcgtgtcgtgagatgttgggttaagtcccgcaacgagcgcaacccttatcttcagttgccatcattaagttgggcactctgaagaaactgccggtgtcaaaccggaggaaggtggggatgacgtcaagtcctcatggcccttatgtccagggctacacacgtgctacaatggccggtacaaagagttgcgatgccgcgaggtggagccaatctcaaaaagccggtctcagttcggattggagtctgcaactcgactccatgaagtcggaatcgctagtaatcgcggatcagcatgccgcggtgaatacgttcccgggccttgtacacaccgcccgtcacaccacgggagtcgactggtcccgaagtgcgtgagccaacccgcaagggaagcagcgccctaaggaatggtcggtgactggggtgaagtcgtaacaaggtagccgtaggggaacctgcggctggatcacctcctttct

SEQ ID NO: 4063 - DNA, 1561 bp, Geobacter pelophilus
  ref <308>: DATABASE ACCESSION NUMBER: NCBI ACCESSION: NZ_BDQG01000001.1
  ref <309>: DATABASE ENTRY DATE: 2019-04-01
  ref <313>: RELEVANT RESIDUES IN SEQ ID NO: (1)..(1561)
ttaaactggagagtttgatcctggctcagaacgaacgctggcggcgtgcttaacacatgcaagtcgaacgggatccagagcttgctctggtgagagtggcgcacgggtgagtaacgcgtggataacctgccctggtatctggaataacatctcgaaaggggtgctaataccggataagcctacggagccytcggtctctgcaggaaaaggtggcctctatttataagctaccgtatcaggatgggtccgcgtaccattagctagttggtagggtaatggcctaccaaggctacgatggttagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtcagaagggaagaaatggggctggctaatatccagtttccttgacggtaccttcaaaggaagcaccggctaactccgtgccagcagccgcggtaatacggagggtgcaagcgttgttcggatttattgggcgtaaagcgcgtgtaggcggtttcttaagtctgatgtgaaagccctgggctcaacccaggaagtgcattggatactgggagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagaactaggtgttgcgggtattgacccctgcagtgccgcagctaacgcattaagttctccgcctgggaagtacggtcgcaagactaaaactcaaaggaattgacgggggcccgcacaagcggtggagcatgtggtttaattcgacgcaacgcgcagaaccttacctgggcttgacatctgcggaacctccccgaaacgggagggtgccttcgggagccgcaagacaggtgctgcatggctgtcgtcagctcgtgtcgtgagatgttgggttaagtcccgcaacgagcgcaacccctatccttagttgccatcattyagttgggcactctaaggagactgccggtgtcaaaccggaggaaggtggggatgacgtcaagtcctcatggcccttatgtccagggctacacacgtgctacaatggccggtacaaagagcagcrataccgcgaggtggagccaatctcaaaaagccggtctcagttcggattggagtctgcaactcgactccatgaagttggaatcgctagtaatcgcggatcagcacgccgcggtgaatacgttcccgggccttgtacacaccgcccgtcacaccacgggagtcggttkgtcccgaagtgcgtgagctaacccgcaagggaggcagcgtcctaaggaatggccggtgactggggtgaagtcgtaacaaggtagccgtaggggaacctgcggctggatcacctcctttctaa

SEQ ID NO: 4064 - DNA, 1559 bp, Geobacter pickeringii
  ref <308>: DATABASE ACCESSION NUMBER: NCBI ACCESSION: NZ_CP009788.1
  ref <309>: DATABASE ENTRY DATE: 2019-04-01
  ref <313>: RELEVANT RESIDUES IN SEQ ID NO: (1)..(1559)
aaactggagagtttgatcctggctcagaacgaacgctggcggcgtgcctaacacatgcaagtcgaacgcgaaaggggcttcggccctgagtaaagtggcgcacgggtgagtaacgcgtggataatctgcccgacgatctgggataacatctcgaaaggggtgctaataccggataagcccacggagtcttaggattctgcgggaaaagggggggaccttcgggcctcttgtcgtcggatgagtccgcgtaccattagctagttggcggggtaaaggcccaccaaggcgacgatggttagctggtctgagaggatgatcagccacactggaactgagacacggtccagactcctacgggaggcagcagtggggaattttgcgcaatgggcgaaagcctgacgcagcaacgccgcgtgagtgatgaaggccttcgggtcgtaaagctctgacagaagggaagaaatgcgggacggataatacctgtttcgcttgacggtaccttcaaaggaagcaccggctaactccgtgccagcagccgcggtaatacggagggtgcaagcgttgttcggaattattgggcgtaaagcgcgtgtaggcggtcttttaagtctgatgtgaaagccccgggctcaacctgggaagtgcattggaaactgggagacttgaatacgggagagggcagtggaattcctagtgtaggagtgaaatccgtagatattaggaggaacaccggtggcgaaggcggctgcctggaccgatattgacgctgagacgcgaaagcgtggggagcaaacaggattagataccctggtagtccacgccgtaaacgatgagtactaggtgttgcgggtattgacccctgcagtgccgcagctaacgcattaagtactccgcctgggaagtacggtcgcaagactaaaactcaaaggaattgacgggggcccgcacaagcggtggagcatgtggtttaattcgacgcaacgcgcagaaccttacctgggcttgacatccgcggaatcctgtggaaacacgggagtgccttcgggagccgcgagacaggtgctgcatggctgtcgtcagctcgtgtcgtgagatgttgggttaagtcccgcaacgagcgcaacccctatccctagttgccatcattaagttgggcactctaaggagactgccggtgtcaaaccggaggaaggtggggatgacgtcaagtcctcatggcccttatgtccagggctacacacgtgctacaatggccggtacaaagagtagcgatgccgcgaggtggagccaatctcataaagccggtctcagttcggattggagtctgcaactcgactccatgaagttggaatcgctagtaatcgcggatcagcatgccgcggtgaatacgttcccgggccttgtacacaccgcccgtcacaccacgggagtcgattggtcccgaagtgcgtgagctaacccctcggggaggcagcgccctaaggaatggtcggtgactggggtgaagtcgtaacaaggtagccgtaggggaacctgcggctggatcacctcctttctaa

SEQ ID NO: 4065 - DNA, 1561 bp, Geobacter soli
  ref <308>: DATABASE ACCESSION NUMBER: NCBI ACCESSION: NZ_JXBL01000001.1
  ref <309>: DATABASE ENTRY DATE: 2019-04-01
  ref <313>: RELEVANT RESIDUES IN SEQ ID NO: (1)..(1561)
aaactggagagtttgatcctggctcagaacgaacgctggcggcgtgcctaacacatgcaagtcgaacgtgatccgcccttcggggtggtgaaagtggcgcacgggtgagtaacgcgtggataatctgcccgaggatttgggataacatctcgaaaggggtgctaataccgaataagcccacggggtctacggatcttgcgggaaaagggggggaccttcgggcctcctgtccttggatgagtctgcgtaccattagctagttggtggggtaatggcctaccaaggcgacgatggttagctggtctgagaggatgatcagccacactggaactgagacacggtccagactcctacgggaggcagcagtggggaattttgcgcaatgggggaaaccctgacgcagcaacgccgcgtgggtgatgaaggccttcgggtcgtaaagctctgtctggagggaagaaatgattgggagctaatacctcttgatcttgacggtacctctgaaggaagcaccggctaactccgtgccagcagccgcggtaatacggagggtgcaagcgttgttcggaattattgggcgtaaagcgcgtgtaggcggtcttttaagtctgatgtgaaagccccgggctcaacctgggaagtgcattggaaactgggaggcttgagtacgggagaggagagtggaattcctagtgtaggagtgaaatccgtagatattaggaggaacaccggtggcgaaggcggctctctggaccgatactgacgctgagacgcgaaagcgtgggtagcaaacaggattagataccctggtagtccacgccgtaaacgatgagtactaggtgttgcgggtattgacccctgcagtgccgtagctaacgcattaagtactccgcctgggaagtacggtcgcaagactaaaactcaaaggaattgacgggggcccgcacaagcggtggagcatgtggtttaattcgacgcaacgcgcagaaccttacctgggcttgacatccacggaaccctcccgaaacggaggggtgcccttcggggagccgtgagacaggtgctgcatggctgtcgtcagctcgtgtcgtgagatgttgggttaagtcccgcaacgagcgcaacccttgtcatcagttgccatcattcagttgggcactctgatgaaactgccggtgtcaaaccggaggaaggtggggatgacgtcaagtcctcatggcccttatgtccagggctacacacgtgctacaatggccggtacaaagagtagcaataccgcgaggtggagccaatctcagaaagccggtctcagttcggattggagtctgcaactcgactccatgaagtcggaatcgctagtaatcgcggatcagcatgccgcggtgaatacgttcccgggccttgtacacaccgcccgtcacaccacgggagtcgactggtcccgaagtgcgtgagctaaccccttgtgggaggcagcgtcctaaggaatggtcggtgactggggtgaagtcgtaacaaggtagccgtaggggaacctgcggctggatcacctcctttctaa

SEQ ID NO: 4066 - DNA, 1557 bp, Geobacter sp. DSM 2909
  ref <308>: DATABASE ACCESSION NUMBER: NCBI ACCESSION: NZ_QAXR01000052.1
  ref <309>: DATABASE ENTRY DATE: 2019-04-01
  ref <313>: RELEVANT RESIDUES IN SEQ ID NO: (1)..(1557)
aaactggagagtttgatcctggctcagaacgaacgctggcggcgtgcttaacacatgcaagtcgaacgcgaaagggacttcggtcctgagtaaagtggcgcacgggtgagtaacgcgtggataatctacccgatggaccgggataacatttcgaaaggggtgctaataccggataagaccacggcttcttagggggctgcggtaaaaggtggggaccttcgggcctaccgtcatcggatgagtccgcgtaccattagctagttggtagggtaagagcctaccaaggcgacgatggttagctggtctgagaggatgatcagccacactggaactgagacacggtccagactcctacgggaggcagcagtggggaattttgcgcaatgggggaaaccctgacgcagcaacgccgcgtgagtgatgaaggccttcgggtcgtaaagctctgtcagaggggaagaaatgcaggggtgctaatatcatctttgcttgacggtaccctcaaaggaagcaccggctaactccgtgccagcagccgcggtaatacggagggtgcgagcgttgttcggaattattgggcgtaaagcgcgtgtaggcggtttggtaagtctgatgtgaaagccccgggctcaacctgggaagtgcattggaaactgtcagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagtactaggtgttgcgggtattgacccctgcagtgccgcagctaacgcattaagtactccgcctgggaagtacggtcgcaagactaaaactcaaaggaattgacgggggcccgcacaagcggtggagcatgtggtttaattcgacgcaacgcgaagaaccttacctgggcttgacatctgcggaaccttgtggaaacacgagggtgccttcgggagccgcaagacaggtgctgcatggctgtcgtcagctcgtgtcgtgagatgttgggttaagtcccgcaacgagcgcaacccctatccttagttgccatcattcagttgggcactctaaggagactgccggtgtcaaaccggaggaaggtggggatgacgtcaagtcctcatggcccttatgtccagggctacacacgtgctacaatggtcggtacaaagggttgcgataccgtgaggtggagccaatcccataaagccggtctcagttcggattggagtctgcaactcgacttcatgaagttggaatcgctagtaatcgcggatcagcatgccgcggtgaatacgttcccgggccttgtacacaccgcccgtcacaccacgggagtcgattggtcccgaagtgcgtgagctaacccttttgggaggcagcgtcctaaggaatggtcggtgactggggtgaagtcgtaacaaggtagccgtaggggaacctgcggctggatcacctcctttct

SEQ ID NO: 4067 - DNA, 1561 bp, Geobacter sp. M18
  ref <308>: DATABASE ACCESSION NUMBER: NCBI ACCESSION: NC_014973.1
  ref <309>: DATABASE ENTRY DATE: 2019-04-01
  ref <313>: RELEVANT RESIDUES IN SEQ ID NO: (1)..(1561)
ttaaactggagagtttgatcctggctcagaacgaacgctggcggcgtgcttaacacatgcaagtcgaacgggattcggagcttgctccgatgagagtggcgcacgggtgagtaacgcgtggataacctgccctggtatccggaataacatctcgaaaggggtgctaataccggataagcctacggggtcttcggactctgcaggaaaaggtggcctctatttataagctaccgtatcaggatgggtccgcgtaccattagctagttggtggggtaatggcctaccaaggcgacgatggttagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtcagtagggaagaaatggaaacggttaatacccgtttttcttgacggtacctacaaaggaagcaccggctaactccgtgccagcagccgcggtaatacggagggtgcaagcgttgttcggatttattgggcgtaaagcgcgtgtaggcggtttcttaagtctgatgtgaaagccctgggctcaacccaggaagtgcattggatactgggagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagaactaggtgttgcgggtattgacccctgcagtgccgcagctaacgcattaagttctccgcctgggaagtacggtcgcaagactaaaactcaaaggaattgacgggggcccgcacaagcggtggagcatgtggtttaattcgacgcaacgcgcagaaccttacctgggcttgacatctacggaatctctgtgaaagcagggagtgccttcgggagccgtaagacaggtgctgcatggctgtcgtcagctcgtgtcgtgagatgttgggttaagtcccgcaacgagcgcaacccctattgctagttgccatcattaagttgggcactctagtgagactgccggtgtcaaaccggaggaaggtggggatgacgtcaagtcctcatggcccttatgtccagggctacacacgtgctacaatggccggtacaaagagttgcgatgccgcgaggtggagccaatctcaaaaagccggtctcagttcggattggagtctgcaactcgactccatgaagttggaatcgctagtaatcgcggatcagcacgccgcggtgaatacgttcccgggccttgtacacaccgcccgtcacaccacgggagtcggttggtcccgaagtgcgtgagctaacccgcaagggaggcagcgtcctaaggaatggccggtgactggggtgaagtcgtaacaaggtagccgtaggggaacctgcggctggatcacctcctttctaa

SEQ ID NO: 4068 - DNA, 1561 bp, Geobacter sp. M21
  ref <308>: DATABASE ACCESSION NUMBER: NCBI ACCESSION: NC_012918.1
  ref <309>: DATABASE ENTRY DATE: 2019-04-01
  ref <313>: RELEVANT RESIDUES IN SEQ ID NO: (1)..(1561)
ttaaactggagagtttgatcctggctcagaacgaacgctggcggcgtgcttaacacatgcaagtcgaacgggatccagagcttgctctggtgagagtggcgcacgggtgagtaacgcgtggataacctgccctggtatctggaataacatctcgaaaggggtgctaataccggataagcctacggagccttcggtctctgcaggaaaaggtggcctctatttataagctaccgtatcaggatgggtccgcgtaccattagctagttggtagggtaatggcctaccaaggctacgatggttagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtcagtagggaagaaatgagacgtgctaataccacgttttcttgacggtacctacaaaggaagcaccggctaactccgtgccagcagccgcggtaatacggagggtgcaagcgttgttcggatttattgggcgtaaagcgcgtgtaggcggttttttaagtctgatgtgaaagccctgggctcaacccaggaagtgcattggatactggaagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagaactaggtgttgcgggtattgacccctgcagtgccgcagctaacgcattaagttctccgcctgggaagtacggtcgcaagactaaaactcaaaggaattgacgggggcccgcacaagcggtggagcatgtggtttaattcgacgcaacgcgcagaaccttacctgggcttgacatctgcggaatccctgtgaaagcagggagtgccttcgggagccgcaagacaggtgctgcatggctgtcgtcagctcgtgtcgtgagatgttgggttaagtcccgcaacgagcgcaacccctatccttagttgccatcatttagttgggcactctaaggagactgccggtgtcaaaccggaggaaggtggggatgacgtcaagtcctcatggcccttatgtccagggctacacacgtgctacaatggccggtacaaagagcagcgataccgcgaggtggagccaatctcaaaaagccggtctcagttcggattggagtctgcaactcgactccatgaagttggaatcgctagtaatcgcggatcagcacgccgcggtgaatacgttcccgggccttgtacacaccgcccgtcacaccacgggagtcggttggtcccgaagtgcgtgagctaacccgcaagggaggcagcgtcctaaggaatggccggtgactggggtgaagtcgtaacaaggtagccgtaggggaacctgcggctggatcacctcctttctaa

SEQ ID NO: 4069 - DNA, 1559 bp, Geobacter sp. OR-1
  ref <308>: DATABASE ACCESSION NUMBER: NCBI ACCESSION: NZ_BAZF01000044.1
  ref <309>: DATABASE ENTRY DATE: 2019-04-01
  ref <313>: RELEVANT RESIDUES IN SEQ ID NO: (1)..(1559)
aaactggagagtttgatcctggctcagaacgaacgctggcggcgtgcctaacacatgcaagtcgaacggggttaaggggcttgctccttaacttagtggcgcacgggtgagtaacgcgtggataatctgcccgatgctctgggataacatctcgaaaggggtgctaataccggataagcccacggactctttggagtttgcgggaaaagggggggaccttcgggcctcccgacatcggatgagtccgcgtcccattagctagttggtggggtaaaggcctaccaaggcgacgatgggtagctggtctgagaggatgatcagccacactggaactgagacacggtccagactcctacgggaggcagcagtggggaattttgcgcaatgggggcaaccctgacgcagcaacgccgcgtgagtgatgaaggcctttgggtcgtaaagctctgtcagagggaaagaaatgtgggcgactaataattgttccacttgacggtaccctcaaaggaagcaccggctaactccgtgccagcagccgcggtaatacggagggtgcgagcgttgttcggaattattgggcgtaaagcgcgtgtaggcggtttattaagtctgatgtgaaagccctgggctcaacctgggaagtgcattggatactggtagacttgagtacgggagagggcagtggaattcccagtgtaggagtgaaatccgtagatattgggaggaacaccggtggcgaaggcggctgcctggaccgatactgacgctgagacgcgaaagcgtggggagcaaacaggattagataccctggtagtccacgccgtaaacgatgagtactaggtgttgcgggtattgacccctgcagtgccgtagctaacgcattaagtactccgcctgggaagtacggtcgcaagactaaaactcaaaggaattgacgggggcccgcacaagcggtggagcatgtggtttaattcgaagcaacgcgcagaaccttacctgggcttgacatctacggaaccttgtggaaacacaggggtgccttcgggagccgtaagacaggtgctgcatggctgtcgtcagctcgtgtcgtgagatgttgggttaagtcccgcaacgagcgcaacccctatccctagttgccatcattaagttgggcactctagagagactgccggtgttaaaccggaggaaggtggggatgacgtcaagtcctcatggcccttatgtccagggctacacacgtgctacaatggccggtacaaagagttgcgatactgcgaggtggagctaatctcataaagccggtctcagttcggattggagtctgcaactcgactccatgaagttggaatcgctagtaatcgcggatcagcatgccgcggtgaatacgttcccgggccttgtacacaccgcccgtcacaccacgggagtcgattggtcccgaagtgcgtgagctaacccttttgggaggcagcgtcctaaggaatggtcggtgactggggtgaagtcgtaacaaggtagccgtaggggaacctgcggctggatcacctcctttctaa

SEQ ID NO: 4070 - DNA, 1558 bp, Geobacter sp. S43
  ref <308>: DATABASE ACCESSION NUMBER: NCBI ACCESSION: NZ_RAHW01000015.1
  ref <309>: DATABASE ENTRY DATE: 2019-04-01
  ref <313>: RELEVANT RESIDUES IN SEQ ID NO: (1)..(1558)
ttaaactggagagtttgatcctggctcagaacgaacgctggcggcgtgcttaacacatgcaagtcgaacgggatccagagcttgctctggtgagagtggcgcacgggtgagtaacgcgtggataacctgccctggtatctggaataacatctcgaaaggggtgctaataccggataagcccacggggtcttcggactctgcgggaaaaggtggcctctgaatatgctaccgtatcaggatgggtccgcgtaccattagctagttggtagggtaatggcctaccaaggctacgatggttagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtcagtagggaagaagtgtaagggtgctaataccatctttacttgacggtacctacaaaggaagcaccggctaactccgtgccagcagccgcggtaatacggagggtgcaagcgttgttcggatttattgggcgtaaagcgcgtgtaggcggtttcttaagtctgatgtgaaagccctgggctcaacccaggaagtgcattggatactgggagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagaactaggtgttgcgggtattgacccctgcagtgccgcagctaacgcattaagttctccgcctgggaagtacggtcgcaagactaaaactcaaaggaattgacgggggcccgcacaagcggtggagcatgtggtttaattcgacgcaacgcgcagaaccttacctgggcttgacatctacggaacctggtggaaacatcggggtgccttcgggagccgtaagacaggtgctgcatggctgtcgtcagctcgtgtcgtgagatgttgggttaagtcccgcaacgagcgcaacccctattgctagttgccatcattcagttgggcactctagtgagactgccggtgtcaaaccggaggaaggtggggatgacgtcaagtcctcatggcccttatgtccagggctacacacgtgctacaatggccggtacaaagagttgcgatgccgtgaggtggagccaatctcaaaaagccggtctcagttcggattggagtctgcaactcgactccatgaagttggaatcgctagtaatcgcggatcagcacgccgcggtgaatacgttcccgggccttgtacacaccgcccgtcacaccacgggagtcggttggtcccgaagtgcgtgagctaacccgcaagggaggcagcgtcctaaggaatggccggtgactggggtgaagtcgtaacaaggtagccgtaggggaacctgcggctggatcacctcctttct

SEQ ID NO: 4071 - DNA, 1560 bp, Geobacter sulfurreducens
  ref <308>: DATABASE ACCESSION NUMBER: NCBI ACCESSION: NZ_AP017912.1
  ref <309>: DATABASE ENTRY DATE: 2019-04-01
  ref <313>: RELEVANT RESIDUES IN SEQ ID NO: (1)..(1560)
aaactggagagtttgatcctggctcagaacgaacgctggcggcgtgcctaacacatgcaagtcgaacgtgatccatccttcggggtggtgaaagtggcgcacgggtgagtaacgcgtggataatctgcccgaggatttgggataacatctcgaaaggggtgctaataccgaataagcccacggggtctacggatcttgcgggaaaagggggggactttcgggcctcctgtcttcggatgagtccgcgtaccattagctagttggtggggtaatggcctaccaaggcgacgatggttagctggtctgagaggatgatcagccacactggaactgagacacggtccagactcctacgggaggcagcagtggggaattttgcgcaatgggggaaaccctgacgcagcaacgccgcgtgggtgatgaaggccttcgggtcgtaaagccctgtcgggaggaaagaaatgattgagggctaatacctcttgatcttgacggtacctccgaaggaagcaccggctaactccgtgccagcagccgcggtaatacggagggtgcaagcgttgttcggaattattgggcgtaaagcgcgtgtaggcggtcttttaagtctgatgtgaaagccccgggctcaacctgggaagtgcattggaaactgggagacttgagtacgggagaggagagtggaattcctagtgtaggagtgaaatccgtagatattaggaggaacaccggtggcgaaggcggctctctggaccgatactgacgctgagacgcgaaagcgtgggtagcaaacaggattagataccctggtagtccacgccgtaaacgatgagtactaggtgttgcgggtattgacccctgcagtgccgtagctaacgcattaagtactccgcctgggaagtacggtcgcaagactaaaactcaaaggaattgacgggggcccgcacaagcggtggagcatgtggtttaattcgacgcaacgcgcagaaccttacctgggcttgacatccacggaaccctcccgaaacggaggggtgcccttcggggagccgtgagacaggtgctgcatggctgtcgtcagctcgtgtcgtgagatgttgggttaagtcccgcaacgagcgcaacccttatcatcagttgccatcattaagttgggcactctgatgaaactgccggtgtcaaaccggaggaaggtggggatgacgtcaagtcctcatggcccttatgtccagggctacacacgtgctacaatggccggtacaaagagtcgcaatgccgcgaggtggagccaatctcaaaaagccggtctcagttcggattggagtctgcaactcgactccatgaagtcggaatcgctagtaatcgcggatcagcatgccgcggtgaatacgttcccgggccttgtacacaccgcccgtcacaccacgggagtcgactggtcccgaagtgcgtgagctaaccagcaatggaggcagcgtcctaaggaatggtcggtgactggggtgaagtcgtaacaaggtagccgtaggggaacctgcggctggatcacctcctttctaa

SEQ ID NO: 4072 - DNA, 1562 bp, Geobacter thiogenes
  ref <308>: DATABASE ACCESSION NUMBER: NCBI ACCESSION: NZ_FUWR01000017.1
  ref <309>: DATABASE ENTRY DATE: 2019-04-01
  ref <313>: RELEVANT RESIDUES IN SEQ ID NO: (1)..(1562)
aaactggagagtttgatcctggctcagaacgaacgctggcggcgtgcctaacacatgcaagtcgaacggagtgaaggagcttgctctttcatttagtggcgcacgggtgagtaacgcgtagataatctgccttagactctgggataacatctcgaaaggggtgctaatacctgataagcccacgatggcgaaagtcgttgcgggaaaagggggcctctgaatatgctcttgatctaagatgagtctgcgtaccattagctagttggtagggtaagagcctaccaaggctacgatggttagctggtctgagaggatgatcagccacactggaactgagacacggtccagactcctacgggaggcagcagtggggaattttgcgcaatgggggaaaccctgacgcagcaacgccgcgtgagtgatgaaggctttcgggtcgtaaagctctgtctagagggaagaaatgataattggttaatacccggttttcttgacggtacctctgaaggaagcaccggctaactccgtgccagcagccgcggtaatacggagggtgcaagcgttgttcggatttattgggcgtaaagcgcgtgtaggcggtttgttaagtctgatgtgaaagccctgggctcaacctgggaagtgcattggaaactggcagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagtactaggtgttgcgggtattgacccctgcagtgccgcagctaacgcattaagtactccgcctgggaagtacggtcgcaagactaaaactcaaaggaattgacgggggcccgcacaagcggtggagcatgtggtttaattcgacgcaacgcgcagaaccttacctggtcttgacatctacggaaccttcgtgaaagcgaggggtgcctttcggggagccgtaagacaggtgctgcatggctgtcgtcagctcgtgtcgtgagatgttgggttaagtcccgcaacgagcgcaacccctatcctcagttgccatcattaagttgggcactctgtggagactgccggtgttaaaccggaggaaggtggggatgacgtcaagtcctcatggcccttatgaccagggctacacacgtgctacaatggccggtacaaagagttgcgatacagcgatgtggagctaatctcataaagccggtctcagttcggattggagtctgcaactcgactccatgaagttggaatcgctagtaatcgcggatcagcatgccgcggtgaatacgttcccgggccttgtacacaccgcccgtcacaccacgggagtcgattggtcccgaagtacgtgagctaacccttttgggaggcagcgtcctaaggaatggtcggtgactggggtgaagtcgtaacaaggtagccgtaggggaacctgcggctggatcacctcctttctaa

SEQ ID NO: 4073 - DNA, 1556 bp, Geobacter uraniireducens
  ref <308>: DATABASE ACCESSION NUMBER: NCBI ACCESSION: NC_009483.1
  ref <309>: DATABASE ENTRY DATE: 2019-04-01
  ref <313>: RELEVANT RESIDUES IN SEQ ID NO: (1)..(1556)
aaactggagagtttgatcctggctcagaacgaacgctggcggcgtgcttaacacatgcaagtcgaacgagaatcggagcttgctccgaggatagtggcgcacgggtgagtaacgcgtggataacctgccctggtatctgggataacatctcgaaaggggtgctaataccggataagcccacgggaactttggttcttgcgggaaaaggtggcctctgaatatgctactgtatcaggatgggtccgcgtaccattagctagttggtggtgtaatggaccaccaaggcgacgatggttagctggtctgagaggatgatcagccacactggaactgagacacggtccagactcctacgggaggcagcagtggggaattttgcgcaatgggggaaaccctgacgcagcaacgccgcgtgagtgatgaaggccttcgggtcgtaaagctctgtcagaggggaagaagtgtatgggtgctaataccatctttacttgacggtaccctcaaaggaagcaccggctaactccgtgccagcagccgcggtaatacggagggtgcaagcgttgttcggatttattgggcgtaaagcgcgtgtaggcggttttttaagtctgatgtgaaagccctgggctcaacccaggaagtgcattggaaactggaagacttgaatacgggagagggtagtggaattcctagtgtaggagtgaaatccgtagatattaggaggaacaccggtggcgaaggcggctacctggaccgatattgacgctgagacgcgaaagcgtggggagcaaacaggattagataccctggtagtccacgccgtaaacgatgagaactaggtgttgcgggtattgacccctgcagtgccgcagctaacgcattaagttctccgcctgggaagtacggtcgcaagactaaaactcaaaggaattgacgggggcccgcacaagcggtggagcatgtggtttaattcgacgcaacgcgcagaaccttacctgggcttgacatctgcggaacctggtggaaacatcggggtgccttcgggagccgcaagacaggtgctgcatggctgtcgtcagctcgtgtcgtgagatgttgggttaagtcccgcaacgagcgcaacccctgtccttagttgccatcattcagttgggcactctaaggagactgccggtgttaaaccggaggaaggtggggatgacgtcaagtcctcatggcccttatgtccagggctacacacgtgctacaatggccggtacaaagagttgcgatgccgcgaggtggagctaatctcaaaaagccggtctcagttcggattggagtctgcaactcgactccatgaagttggaatcgctagtaatcgcggatcagcatgccgcggtgaatacgttcccgggccttgtacacaccgcccgtcacaccacgggagtcgattggtcccgaagtgcgtgagctaacccgcaagggaggcagcgtcctaaggaatggtcggtgactggggtgaagtcgtaacaaggtagccgtaggggaacctgcggctggatcacctcctttct

SEQ ID NO: 4074 - DNA, 1538 bp, Geodermatophilus sp. LHW52908
  ref <308>: DATABASE ACCESSION NUMBER: NCBI ACCESSION: NZ_QVQH01000054.1
  ref <309>: DATABASE ENTRY DATE: 2019-04-01
  ref <313>: RELEVANT RESIDUES IN SEQ ID NO: (1)..(1538)
tctacggagagtttgatcctggctcaggacgaacgctggcggcgtgcttaacacatgcaagtcgaacggtgaacccgcttcggtgggggatcagtggcgaacgggtgagtaacacgtgggcaacctgcccccggctctgggataactccaagaaattggggctaataccggatgtgcactgctggtcgcatggccggtggtggaaagactggttcggctggggatgggcccgcggcctatcagcttgttggtggggtagtggcctaccaaggcgacgacgggtagccggcctgagagggtgaccggccacactgggactgagacacggcccagactcctacgggaggcagcagtggggaatattgcgcaatgggcggaagcctgacgcagcgacgccgcgtgggggatgacggccttcgggttgtaaacctctttcagcagggacgaagccgttcagcggtgacggtacctgcagaagaagcaccggccaactacgtgccagcagccgcggtaatacgtagggtgcaagcgttgtccggaattattgggcgtaaagagctcgtaggcggttggtcgcgtcggctgtgaaaacccggagctcaactccgggcctgcagtcgatacgggccgacttgagtgttgcaggggagactggaattcctggtgtagcggtgaaatgcgcagatatcaggaggaacaccggtggcgaaggcgggtctctgggcagcaactgacgctgaggagcgaaagcgtggggagcgaacaggattagataccctggtagtccacgccgtaaacgttgggcgctaggtgtgggggccattccacggtctccgtgccgcagctaacgcattaagcgccccgcctggggagtacggccgcaaggctaaaactcaaaggaattgacgggggcccgcacaagcggcggagcatgttgcttaattcgatgcaacgcgaagaaccttacctaggcttgacatgcgcggaaatcctccagagatggggggtccgcaagggccgtgcacaggtggtgcatggttgtcgtcagctcgtgtcgtgagatgttgggttaagtcccgcaacgagcgcaaccctcgttccatgttgccagcggatcatgccggggactcatgggagactgccggggtcaactcggaggaaggtggggatgacgtcaaatcatcatgccccttatgtctagggctgcaaacatgctacaatggccggtacaaagggctgcgataccgcgaggtggagcgaatcccaaaaagccggtctcagttcggattggggtctgcaactcgaccccatgaagttggagtcgctagtaatcgcagatcagcaacgctgcggtgaatacgttcccgggccttgtacacaccgcccgtcacgtcacgaaagtcggtaacgcccgaagccggtggcccaaccccttaccgggagggagccgtcgaaggcgggatcggcgattgggacgaagtcgtaacaaggtagccgtaccggaaggtgcggctggatcacctcctttctaaggagca

SEQ ID NO: 4075 - DNA, 1350 bp, Geomicrobium sp. JCM 19037
  ref <308>: DATABASE ACCESSION NUMBER: NCBI ACCESSION: NZ_BAWZ01000071.1
  ref <309>: DATABASE ENTRY DATE: 2019-04-01
  ref <313>: RELEVANT RESIDUES IN SEQ ID NO: (1)..(1350)
gaggaaaggcggtttcggccgtcactgttggaggggcccgcggcgcattagctagttggtgaggtaagggctcaccaaggcgacgatgcgtagccgacctgagagggtgatcggccacactggaactgagacacggtccagactcctacgggaggcagcagtagggaatcatccgcaatgggcgaaagcctgacggtgcaatgccgcgtgagtgatgaaggttttcggatcgtaaagctctgttgtgagggaagaacagttcgaggaggcaatgcctcggatgtgacggtacctcaccagaaagccacggctaactacgtgccagcagccgcggtaatacgtaggtggcgagcgttgtccggaattattgggcgtaaagggcacgcaggcggttcattaagtctgatgtgaaaggctgtggctcaaccacagaatggcattggaaactgttgaacttgagtgcagaagaggagagtggaattccacgtgtagcggtgaaatgcgtagatatgtggaggaacaccagtggcgaaggcgactctctggtctgtaactgacgctgaggtgcgaaagcgtggggagcgaacaggattagataccctggtagtccacgccgtaaacgttgagtgctaggtgttaggggtttcgatacccgtagtgccgaagcaaacgcattaagcactccgcctggggagtacgaccgcaaggttgaaactcaaaggaattgacgggggcccgcacaagcggtggagcatgtggtttaattcgacgcaacgcgaagaaccttaccaggtcttgacatcctttgatcgctctagagatagagttttcccttcggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggcggggatgacgtcaaatcatcatgccccttatgacctgggctacacacgtgctacaatggacggtacaacgggaagcgaagccgcgaggtggagccaatcctaaaaagccgttctcagttcggattgtaggctgcaactcggctacatgaagctggaatcgctagtaatcgcggatcagcatgccgcggtgaatacgttcccgggccttgtacacaccgcccgtcacaccacgagagccagcaacacccgaagtcggtgaggcaacctttatggagccagccgccgaaggtggggccggtgattggggtgaagtcgtaacaaggtatccctaccggaaggtggggatggatcacctcctttcta

SEQ ID NO: 4076 - DNA, 1551 bp, Geomicrobium sp. JCM 19038
  ref <308>: DATABASE ACCESSION NUMBER: NCBI ACCESSION: NZ_BAXA01000031.1
  ref <309>: DATABASE ENTRY DATE: 2019-04-01
  ref <313>: RELEVANT RESIDUES IN SEQ ID NO: (1)..(1551)
atggagagtttgatcctggctcaggacgaacgctggcggcatgcctaatacatgcaagtcgagcggacccgaggtgcttgcacctcaatgggtcagcggcggacgggtgagtaacacgtgggcaacctgcccaacagactgggataactccgggaaaccggagctaataccggatatcctcttttcaccacctggtgaaaagagaaaaggcggtttcggccgccactgttggatgggcccgcggcgcattagctagttggtgaggtaagggctcaccaaggcgacgatgcgtagccgacctgagagggtgatcggccacactggaactgagacacggtccagactcctacgggaggcagcagtagggaatcatccgcaatgggcgaaagcctgacggtgcaatgccgcgtgagtgatgaaggttttcggatcgtaaagctctgttgtgagggaagaacaagttcgggaggaaatgcccgagccgtgacggtacctcaccagaaagccacggctaactacgtgccagcagccgcggtaatacgtaggtggcaagcgttgtccggaattattgggcgtaaagggcacgcaggcggttctttaagtctgatgtgaaaggctgtggctcaaccacagaattgcattggaaactggagaacttgagtgcagaagaggagagtggaattccacgtgtagcggtgaaatgcgtagatatgtggaggaacaccagtggcgaaggcgactctctggtctgtaactgacgctgaggtgcgaaagcgtggggagcaaacaggattagataccctggtagtccacgccgtaaacgttgagtgctaggtgttaggggtttcgatacccgtagtgccgaagcaaacgcattaagcactccgcctggggagtacgaccgcaaggttgaaactcaaaggaattgacgggggcccgcacaagcggtggagcatgtggtttaattcgacgcaacgcgaagaaccttaccaggtcttgacatcctttgatcgctctagagatagagttttcccttcggggacaaagtgacaggtggtgcatggttgtcgtcagctcgtgtcgtgagatgttgggttaagtcccgcaacgagcgcaacccttgaccttagttgccagcatttagttgggcactctaaggtgactgccggtgacaaaccggaggaaggcggggatgacgtcaaatcatcatgccccttatgacctgggctacacacgtgctacaatggacggtacaacgggaagcgaagccgcgaggtggagccaatcctaaaaagccgttctcagttcggattgtaggctgcaactcgcctacatgaagctggaatcgctagtaatcgcggatcagcatgccgcggtgaatacgttccgggccttgtacacaccgcccgtcacaccacgagagccagcaacacccgaagtcggtgaggcaaccgtttacggagccagccgccgaaggtggggccggtgattggggtgaagtcgtaacaaggtatccctaccggaaggtggggatggatcacctcctttcta

SEQ ID NO: 4077 - DNA, 1538 bp, Geopsychrobacter electrodiphilus
  ref <308>: DATABASE ACCESSION NUMBER: NCBI ACCESSION: NZ_ARWE01000001.1
  ref <309>: DATABASE ENTRY DATE: 2019-04-01
  ref <313>: RELEVANT RESIDUES IN SEQ ID NO: (1)..(1538)
aaactggagagtttgatcctggctcagaacgaacgctggcggcgtgcctaacacatgcaagtcgaacgagaaagggacttcggtcctgagtagagtggcgcacgggtgagtaacacgtggataacctgccctaaggtctgggataacatttcgaaagggatgctaataccggataagcctacgacctcttcgggggatgtaggaaaagatttattgccttgggatgggtccgcggtccattagctagttggtagggtaatggcctaccaaggctacgatggatagctggtctgagaggatgatcagccacactggaactgagacacggtccagactcctacgggaggcagcagtggggaattttgcgcaatgggcgaaagcctgacgcagcaacgccgcgtgaaggatgaaggcccttgggtcgtaaacttctgtcagtggggaagaaatacccgtaagggagctgacggtacccacaaaggaagcaccggctaactccgtgccagcagccgcggtaatacggagggtgcaagcgttgttcggaattattgggcgtaaagcgcgtgtaggtggtctgttaagtctggtgtgaaagccctgggctcaacccaggaagtgcattggatactggcagacttgagtatgggagaggaaagcggaattccgagtgtaggagtgaaatccgtagatattcggaggaacaccagtggcgaaggcggctttctggaccaatactgacactgagacgcgaaagcgtggggagcaaacaggattagataccctggtagtccacgccgtaaacgatgggcactaggtgttgcgggtaaccactcctgcagtgccgaagctaacgcattaagtgccccgcctggggagtacggccgcaaggctaaaactcaaaggaattgacgggggcccgcacaagcggtggagcatgtggtttaattcgacgcaacgcgaagaaccttacctggatttgacatcccgatcgcatcccttggaaacttgggagtcagctcggctggatcggtgacaggtgctgcatggctgtcgtcagctcgtgtcgtgagatgttgggttaagtcccgcaacgagcgcaacccctatccttagttgccatcattaagttgggcactctagggagactgccggtgttaaaccggaggaaggtggggatgacgtcaagtcctcatggcccttatatccagggctacacacgtgctacaatggccggtacaaagggctgcgaactcgcgagagtaagctaatcccaaaaagccggtctcagttcggattggagtctgcaactcgactccatgaagttggaatcgctagtaatcgcgtatcagcatgacgcggtgaatacgttcccgggccttgtacacaccgcccgtcacaccacgggagtctattgtaccggaaaccggtgggctaacccttcggggaggcagccgtttatggtatgatcggtaactggggtgaagtcgtaacaaggtatccgtaccggaaggtgcggatggatcacctcctttctaagg

SEQ ID NO: 4078 - DNA, 1531 bp, Georgenia muralis
  ref <308>: DATABASE ACCESSION NUMBER: NCBI ACCESSION: NZ_RKRA01000001.1
  ref <309>: DATABASE ENTRY DATE: 2019-04-01
  ref <313>: RELEVANT RESIDUES IN SEQ ID NO: (1)..(1531)
ttaacggagagtttgatcctggctcaggacgaacgctggcggcgtgcttaacacatgcaagtcgaacgatgatgccagcttgctggtggattagtggcgaacgggtgagtaacacgtgagcaacctgcccctgacttcgggataaccgcgggaaaccgtggctaataccggatatgacgcgctatcgcatggtggtgtgtggaaagatttatcggttggggatgggctcgcggcctatcagcttgttggtggggtgatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaaggccttcgggttgacggtacctgcagaagaagcgccggctaactacgtgccagcagccgcggtaatacgtagggcgcaagcgttgtccggaattattgggcgtaaagagctcgtaggcggtttgtcgcgtctgctgtgaaaacgcgaggcttaacctcgcgcctgcagtgggtacgggcagactagagtgcggtaggggagactggaattcctggtgtagcggtggaatgcgcagatatcaggaggaacaccggtggcgaaggcgggtctctgggccgttactgacgctgaggagcgaaagcatggggagcgaacaggattagataccctggtagtccatgccgtaaacgttgggcactaggtgtgggacccattccacgggttccgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaaacatccagagatgggtgccccgcaaggtcggtgtacaggtggtgcatggttgtcgtcagctcgtgtcgtgagatgttgggttaagtcccgcaacgagcgcaacccttgtcctgtgttgccagcgggttatgccggggactcatgggagactgccggggtcaactcggaggaaggtggggatgacgtcaaatcatcatgccccttatgtcttgggcttcacgcatgctacaatggccggtacaaagggttgcgatgccgtgaggtggagcgaatcccaaaaagccggtctcagttcggattggggtctgcaactcgaccccatgaagtcggagtcgctagtaatcgcagatcagcaacgctgcggtgaatacgttctcgggccttgtacacaccgcccgtcacgtcacgaaagtcggtaacacccgaagccggtggcccaacctcttgtaggggggagccgtcgaaggtgggactggcgattgggacgaagtcgtaacaaggtagccgtaccggaaggtgcggctggatcacctcctttctaagga

SEQ ID NO: 4079 - DNA, 1532 bp, Georgenia sp. SYP-B2076
  ref <308>: DATABASE ACCESSION NUMBER: NCBI ACCESSION: NZ_RXOZ01000021.1
  ref <309>: DATABASE ENTRY DATE: 2019-04-01
  ref <313>: RELEVANT RESIDUES IN SEQ ID NO: (1)..(1532)
tttacggagagtttgatcctggctcaggacgaacgctggcggcgtgcttaacacatgcaagtcgaacgatgaggcccagcttgctgggttgattagtggcgaacgggtgagtaacacgtgagcaacctgcccctgacttcgggataactccgggaaaccggtgctaataccggatatgacgcctcaccgcatggtggggtgtggaaagactgtgtcggttggggatgggctcgcggcctatcagcttgttggtggggtgatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcctcttggggtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaaacgcgaggcttaacctcgcgcctgcagtgggtacgggcagactagagtgcggtaggggagactggaattcctggtgtagcggtggaatgcgcagatatcaggaggaacaccgatggcgaaggcaggtctctgggccgttactgacgctgaggagcgaaagcatggggagcgaacaggattagataccctggtagtccatgccgtaaacgttgggcactagttgtggggcccgttccacgggttccgtgacgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccggaaacacccagagatgggtgccccgcaaggtcggtgcacaggtggtgcatggttgtcgtcagctcgtgtcgtgagatgttgggttaagtcccgcaacgagcgcaacccttgtcctgtgttgccagcgggttatgccggggactcatgggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttctcgggccttgtacacaccgcccgtcacgtcacgaaagtcggtaacacccgaagccggtggcccaacccttgtggggggagccgtcgaaggtgggactggcgattgggacgaagtcgtaacaaggtagccgtaccggaaggtgcggctggatcacctcctttctaagga

SEQ ID NO: 4080 - DNA, 1531 bp, Georgenia sp. ZLJ0321
  ref <308>: DATABASE ACCESSION NUMBER: NCBI ACCESSION: NZ_RHDW01000009.1
  ref <309>: DATABASE ENTRY DATE: 2019-04-01
  ref <313>: RELEVANT RESIDUES IN SEQ ID NO: (1)..(1531)
tttacggagagtttgatcctggctcaggacgaacgctggcggcgtgcttaacacatgcaagtcgaacggtgatcctggagcttgctccgggtgatcagtggcgaacgggtgagtaacacgtgagtaacctgcccctgacttcgggataactacgagaaatcgtggctaataccggatatgaggtgccttcgcatgggggtgcctggaaagatttatcggttggggatgggctcgcggcctatcagctagttggtggggtgaaggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagccttcgggtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaaacgtgaggcttaacctcgcgcttgcagtgggtacgggcagactagagtgcagtaggggagactggaattcctggtgtagcggtggaatgcgcagatatcaggaggaacaccggtggcgaaggcgggtctctgggctgttactgacgctgaggagcgaaagcatggggagcgaacaggattagataccctggtagtccatgccgtaaacgttgggcactaggtgtggggtccattccacggattccgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaaaagtgcagagatgtgctccccgcaaggtcggtgtacaggtggtgcatggttgtcgtcagctcgtgtcgtgagatgttgggttaagtcccgcaacgagcgcaaccctcgtcctgtgttgccagcacgtaatggtggggactcatgggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttctcgggccttgtacacaccgcccgtcacgtcacgaaagtcggtaacacccgaagccggtggcccaacccttgtggggggagccgtcgaaggtgggactggcgattgggacgaagtcgtaacaaggtagccgtaccggaaggtgcggctggatcacctcctttctaagga

SEQ ID NO: 4081 - DNA, 1531 bp, Georgenia sp. ZLJ0423; identical to SEQ ID NO: 4080
  ref <308>: DATABASE ACCESSION NUMBER: NCBI ACCESSION: NZ_CP033325.1
  ref <309>: DATABASE ENTRY DATE: 2019-04-01
  ref <313>: RELEVANT RESIDUES IN SEQ ID NO: (1)..(1531)

SEQ ID NO: 4082 - DNA, 1525 bp, Geosporobacter ferrireducens
  ref <308>: DATABASE ACCESSION NUMBER: NCBI ACCESSION: NZ_CP017269.1
  ref <309>: DATABASE ENTRY DATE: 2019-04-01
  ref <313>: RELEVANT RESIDUES IN SEQ ID NO: (1)..(1525)
tttttatttgagagtttgatcctggctcaggatgaacgctggcggcgtgcctaacacatgcaagtcgagcgggattgtggagtagcttgctacgaagcaatctagcggcggacgggtgagtaacgcgtgggcaacctgccctatacagggggataacacaccgaaaggtgtgctaataccccataacaccgatgcttcgcatggagagtcggtcaaagatttatcggtataggatgggcccgcgtctgattagctagttggtgaggtaaaggctcaccaaggcgacgatcagtagccgacctgagagggtgatcggccacactggaactgagacacggtccagactcctacgggaggcagcagtggggaatattgcacaatgggggaaaccctgatgcagcaacgccgcgtgagcgatgaaggccttcgggtcgtaaagctctgtcctaagggaagaagaatgacggtaccttaggaggaagccccggctaactacgtgccagcagccgcggtaatacgtagggggcaagcgttatccggaatcactgggcgtaaagggtgcgtaggcggccgataaagtctggggtgaaaggctacggcttaaccgtagtaagccttggaaacttattggcttgagtgcaggagaggtaagtggaattcctagtgtagcggtgaaatgcgtagatattaggaggaacaccagtggcgaaggcgacttactggactgtaactgacgctgaggcacgaaagcgtggggagcgaacaggattagataccctggtagtccacgccgtaaacgatgagtgctaggtgtcgggggcgacagccctcggtgccgcagctaacgcattaagcactccgcctggggagtacgctcgcaagagtgaaactcaaaggaattgacggggacccgcacaagcagcggagcatgtggtttaattcgaagcaacgcgaagaaccttaccaggacttgacatcctccgcattagccgtaacgggtgaaatcccttcggggacggagagacaggtggtgcatggttgtcgtcagctcgtgtcgtgagatgttgggttaagtcccgcaacgagcgcaacccttgtctttagttgccagcaggtgaagctgggcactctagagagactgccggggataactcggaggaaggtggggatgacgtcaaatcatcatgccccttatgttctgggctacacacgtgctacaatggctggtacaacgggaagcgaaggagtaatccggagcaaatcctaaaagccagtctcagttcggattgtgggctgcaactcgcccacatgaagctggagttgctagtaatcgtggatcagaatgccgcggtgaatgcgttcccgggtcttgtacacaccgcccgtcacaccatgggagctcagggcacccgaagtcagtgagctaaccgaaagggagcagctgccgaaggtgaaatgagtgactggggtgaagtcgtaacaaggtagccgtatcggaaggtgcggctggatcacctcctttcta

SEQ ID NO: 4083 - DNA, 1568 bp, Geothermobacter sp. EPR-M
  ref <308>: DATABASE ACCESSION NUMBER: NCBI ACCESSION: NZ_NAAD01000027.1
  ref <309>: DATABASE ENTRY DATE: 2019-04-01
  ref <313>: RELEVANT RESIDUES IN SEQ ID NO: (1)..(1568)
aaactggagagtttgatcctggctcagaacgaacgctggcggcatgcttaacacatgcaagtcgaacgcgaaagtggacttcggtccgcgagtagagtggcgcacgggtgagtaacacgtggataacctacctgatgatctgggataacacttcgaaaggggtgctaataccggataagcctacgattccctcgggttttgtaggaaaagatggcctcttcatgaaagctattgtcatcagatgggtccgcggcccattagctagttggcggggtaatggcccaccaaggcaacgatgggtagctggtctgagaggatgatcagccacactggaactgagacacggtccagactcctacgggaggcagcagtggggaattttgcgcaatgggcgaaagcctgacgcagcaatgccgcgtgagtgaagaaggctcttgggtcgtaaagctctgtcagaggggaagaacctcctggtggttaatacccatcaggattgacggtaccctcaaaggaagcaccggctaactccgtgccagcagccgcggtaatacggagggtgcgagcgttgttcggaattattgggcgtaaagcgcgtgtaggcggtctgttaagtctgatgtgaaagccccgggctcaacccgggaagtgcattggatactggcagacttgagtacgggagaggaaagtggaattccgagtgtaggggtgaaatccgtagatattcggaggaacaccagtggcgaaggcggctttctggaccgatactgacgctgagacgcgaaagcgtggggagcaaacaggattagataccctggtagtccacgccgtaaacgatgggtactaggtgtcgcgggtattgacccctgcggtgccgcagctaacgcattaagtaccccgcctggggagtacggtcgcaagatgaaaactcaaaggaattgacgggggcccgcacaagcggtggagcatgtggtttaattcgacgcaacgcgaagaaccttacctgggtttgacatcccgatcgtatcccatggaaacatgggagtcagcttggctggatcggtgacaggtgctgcatggctgtcgtcagctcgtgtcgtgagatgttgggttaagtcccgcaacgagcgcaacccttgtccttagttgccatcatttagttgggcactctaaggagactgccggtgttaaaccggaggaaggtggggatgacgtcaagtcctcatggcccttatatccagggctacacacgtgctacaatggccggtacaaagggtcgcgataccgcaaggtggagctaatcccaaaaagccggtctcagttcggattggagtctgcaactcgactccatgaagttggaatcgctagtaatcgcgtatcagcatgacgcggtgaatacgttcccgggccttgtacacaccgcccgtcacaccacgggagttgtttgtaccggaaatcggtgggctaaccttcgggaggcagccgcttatggtatgaatagtaactggggtgaagtcgtaacaaggtagccgtaggggaacctgcggctggatcacctcctttctaaggag

SEQ ID NO: 4084 - DNA, 1568 bp, Geothermobacter sp. HR-1
  ref <308>: DATABASE ACCESSION NUMBER: NCBI ACCESSION: NZ_PPFX01000004.1
  ref <309>: DATABASE ENTRY DATE: 2019-04-01
  ref <313>: RELEVANT RESIDUES IN SEQ ID NO: (1)..(1568)
aaactggagagtttgatcctggctcagaacgaacgctggcggcatgcttaacacatgcaagtcgaacgcgaaagtggacttcggtccgcgagtagagtggcgcacgggtgagtaacacgtggataacctacctgatgatctgggataacacttcgaaaggggtgctaataccggataagcctacgattccctcgggttttgtaggaaaagatggcctcttcttgaaagctattgtcatcagatgggtccgcggcccattagctagttggcggggtaatggcccaccaaggcaacgatgggtagctggtctgagaggatgatcagccacactggaactgagacacggtccagactcctacgggaggcagcagtggggaattttgcgcaatgggcgaaagcctgacgcagcaatgccgcgtgagtgaagaaggctcttgggtcgtaaagctctgtcagaggggaagaacctcttggtggttaatacccatcaggattgacggtaccctcaaaggaagcaccggctaactccgtgccagcagccgcggtaatacggagggtgcgagcgttgttcggaattattgggcgtaaagcgcgtgtaggcggtctgttaagtctgatgtgaaagccccgggctcaacccgggaagtgcattggatactggcagacttgagtacgggagaggaaagtggaattccgagtgtaggggtgaaatccgtagatattcggaggaacaccagtggcgaaggcggctttctggaccgatactgacgctgagacgcgaaagcgtggggagcaaacaggattagataccctggtagtccacgccgtaaacgatgggtactaggtgtcgcgggtattgacccctgcggtgccgcagctaacgcattaagtaccccgcctggggagtacggtcgcaagattaaaactcaaaggaattgacgggggcccgcacaagcggtggagcatgtggtttaattcgacgcaacgcgaagaaccttacctgggtttgacatcccgatcgtatcccatggaaacatgggagtcagcttggctggatcggtgacaggtgctgcatggctgtcgtcagctcgtgtcgtgagatgttgggttaagtcccgcaacgagcgcaacccttgtccttagttgccatcatttagttgggcactctaaggagactgccggtgttaaaccggaggaaggtggggatgacgtcaagtcctcatggcccttatatccagggctacacacgtgctacaatggccggtacaaagggtcgcgataccgcaaggtggagctaatcccaaaaagccggtctcagttcggattggagtctgcaactcgactccatgaagttggaatcgctagtaatcgcgtatcagcatgacgcggtgaatacgttcccgggccttgtacacaccgcccgtcacaccacgggagttgtttgtaccggaaatcggtgggctaaccttcgggaggcagccgcttatggtatgaatagtaactggggtgaagtcgtaacaaggtagccgtaggggaacctgcggctggatcacctcctttctaaggag

SEQ ID NO: 4085 - DNA, 1560 bp, Geovibrio sp. L21-Ace-BES
  ref <308>: DATABASE ACCESSION NUMBER: NCBI ACCESSION: NZ_ATWF01000004.1
  ref <309>: DATABASE ENTRY DATE: 2019-04-01
  ref <313>: RELEVANT RESIDUES IN SEQ ID NO: (1)..(1560)
tttggacggagagtttgatcctggctcagaacgaacgctggcggcgtgcttaacacatgcaagtcaaggggaaagcaccttcgggtgtgattacactggcgcacgggtgagtaacgcgtgaggaacctgccccggagagagggataacaactcgaaagagttgctaatacttcataagcccccggtattagtttactgcgggaaaagacggtttcggctgtcgctttgggatggtctcgcgtgtcattagctagttggtgaggtaacggctcaccaaggcaacgatggctaggcggcctgagagggtggccgcccacactggaactgagacacggtccagactcctacgggaggcagcagtggggaattttgcacaatgaccgcaaggttgatgcagcaacgccgcgtgtatgatgaaggctttcgggtcgtaaagtactttcagcagggaagaacggcatggtcagtaactggtccatgtgtgacggtacctgcagaagcagccccggctaactccgtgccagcagccgcggtaatacggagggggcaagcgttgttcggagtcactgggcgtaaagagctcgtaggcggcattgtaagtcgagggttaaaggcatcagcttaactggtgtacggccttcgaaactatgatgctagagtgccggagaggtatgcggaattccctgtgtagcggtgaaatgcgtagatatagggaagaacaccagttgcgaaggcggcatactggccggtaactgacgctgaggagcgaaagcgtgggtagcaaacaggattagataccctggtagtccacgctgtaaacgatggacgctaggtgttggaagtaaccactttcagtgccgaagcaaacgcgttaagcgtcccgcctggggagtacggtcgcaagactgaaactcaaaggaattgacgggggcccgcacaagcggtggagcacgtggtttaattcgatgctaaccgcagaaccttacctgggcttgacatctctggaacaatatagagatatattggtgcttacctttggtaagaaccggatgacaggtgctgcatggctgtcgtcagctcgtgccgtgaggtgttgggttaagtcccgcaacgagcgcaacccctactattagttgccatcaattcggttgggcactctaatgggacagccgtcgacaaggcggaggaaggtggggacgacgtcaagtcatcatggcccttatgtccagggctacacacgtgctacaatggcgtatacagagggcagcgagactgtgaagtcaagcgaatcccacaaagtacgccccagttcagattgcagtctgcaactcgactgcatgaagccggaatcgctagtaatcgcaggtcagcaaaactgcggtgaatacgttcccgggccttgtacacaccgcccgtcacaccacggaagtcggccgtacctgaagccggtggcccaaccttatggagggagccgtctatggtatagctggtaactggggtgaagtcgtaacaaggtagccgtaccggaaggtgtggctggatcacctcctttttaaggaa

SEQ ID NO: 4086 - DNA, 1552 bp, Geovibrio thiophilus
  ref <308>: DATABASE ACCESSION NUMBER: NCBI ACCESSION: NZ_CP035108.1
  ref <309>: DATABASE ENTRY DATE: 2019-04-01
  ref <313>: RELEVANT RESIDUES IN SEQ ID NO: (1)..(1552)
tggatggagagtttgatcctggctcagaacgaacgctggcggcgtgcttaacacatgcaagtctaggggaattcgctttcgggcgatagtacactggcgaacgggtgagtaacgcgtgaggaacctaccctgaagattgggacaacacagagaaatttgtgctaataccggataagcccacgtacttagttgtgtgtgggaaaagacggggtaacctgtcgctttgggatggcctcgcgtgccattagctagttggtagggtaatggcctaccaaggctacgatggctaggcggcctgagagggtggccgcccacactggaactgagacacggtccagactcctacgggaggcagcagtggggaattttgcgcaatgaccgaaaggttgacgcagcaacgccgcgtgtatgatgaaggctttcgggtcgtaaagtactttcagtggggaagaatggcatgaggagtaactgccttgtgattgacggtacccacagaagcagccccggctaactccgtgccagcagccgcggtaatacggagggggcaagcgttgttcggagtcactgggcgtaaagagctcgtaggcggcgatgtaagtcgggagttaaaggcaacagctcaactgttgtagggcttctgaaactacattgctagagtaccagagaggtatgcggaattccctgtgtagcggtgaaatgcgtagatatagggaggaacaccggttgcgaaggcggcatactggctggtaactgacgctgaggagcgaaagcgtgggtagcaaacaggattagataccctggtagtccacgctgtaaacgatggatgctaggtgttggatgtaaccacattcagtgccgaagctaacgcattaagcatcccgcctggggagtacggtcgcaagactgaaactcaaaggaattgacgggggcccgcacaagcggtggagcacgtggtttaattcgatgctaaccgcagaaccttacccgggtttgacatcttcaaaatacgatagagatattgtagtgcttactttcagtaagaattgaatgacaggtgctgcatggctgtcgtcagctcgtgccgtgaggtgttgggttaagtcccgcaacgagcgcaacccctgcttttagttgccatcgggtcaagccgggcactctagaggaacagccgtcgacaaggcggaggaaggtggggacgacgtcaagtcatcatggcccttatgtccggggctacacacgtgctacaatggcgtatacagagggcagcgagacagtgatgttaagcgaatcccagaaagtacgcctcagttcagattgtagtctgcaactcgactacatgaagtcggaatcgctagtaatcgcaggtcagcaaaactgcggtgaatacgttcccgggccttgtacacaccgcccgtcacaccacgggagtcgaccgtacctgaagccggtggcctaaccttttaggagggagccgtctatggtatagttggtaactggggtgaagtcgtaacaaggtagccgtaccggaaggtgtggctggatcacctccttt

SEQ ID NO: 4087 - DNA, 1545 bp, Gibbsiella quercinecans
  ref <308>: DATABASE ACCESSION NUMBER: NCBI ACCESSION: NZ_MJLW01000010.1
  ref <309>: DATABASE ENTRY DATE: 2019-04-01
  ref <313>: RELEVANT RESIDUES IN SEQ ID NO: (1)..(1545)
ttaattgaagagtttgatcatggctcagattgaacgctggcggcaggcctaacacatgcaagtcgagcggcagcggggggaagcttgcttcctcgccggcgagcggcggacgggtgagtaatgtctgggaaactgcccgatggagggggataactactggaaacggtagctaataccgcataacgtcgcaagaccaaagtgggggaccttagggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggggtgatggttaatagccattatcattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtggccttgagccgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccacggaacttggcagagatgccttggtgccttcgggaaccgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgatctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 4088 - DNA, 1532 bp, Glaciecola sp. THG-3.7
  ref <308>: DATABASE ACCESSION NUMBER: NCBI ACCESSION: NZ_CP034120.1
  ref <309>: DATABASE ENTRY DATE: 2019-04-01
  ref <313>: RELEVANT RESIDUES IN SEQ ID NO: (1)..(1532)
tttttacaacggagagtttgatcctggctcaggatgaacgctagcggcaggcctaacacatgcaagtcgaggggtagcaggataaagcttgctttattgctgacgaccggcgcacgggtgcgtaacgcgtatgcaacctaccttatactggggtatagcccggagaaattcggattaatcccccatagtattatcggatcgcatggtttgataattaaaggttacggtataagatgggcatgcgtcccattagctagatggtgaggtaacggctcaccatggcaacgatgggtagggggcctgagagggtggtcccccacactggtactgagacacggaccagactcctacgggaggcagcagtgaggaatattggtcaatgggcgcaagcctgaaccagccatgccgcgtgcaggaagacggtcctatggattgtaaactgcttttattggggaataaacctccttacgtgtagggagctgaaggtacccaatgaataagcaccggctaactccgtgccagcagccgcggtaatacggagggtgcaagcgttatccggaatcattgggtttaaagggtccgcaggcggtcttataagtcagtggtgaaagcctacagctcaactgtagaactgccattgatactgtaagacttgaattcgatcgaagtgggcggaatatgacatgtagcggtgaaatgcttagatatgtcatagaacaccgatagcgaaggcagctcactaggtctggattgacgctcagggacgaaagcgtggggagcaaacaggattagataccctggtagtccacgccgtaaactatcaatactcgttctcagcccttcggggttggggaccaagcgaaagtgataagtattgcacctggggagtacgatcgcaaggttgaaactcaaaggaattgacgggggcccgcacaagcggtggagcatgtggtttaattcgatgatacgcgaggaaccttaccagggcttaaatgtagagggaatattgtggaaacatgatagtcttcggaccgtctacaaggtgctgcatggctgtcgtcagctcgtgccgtgaggtgttgggttaagtcccgcaacgagcgcaacccctatctttagttgccagcggatcatgccggggactctaaagaaactgccagcgcaagctgagaggaaggcggggacgacgtcaagtcatcacggcccttacgtcctgggccacacacgtgctacaatggtcggtacagagggcagctacctagcgataggatgcgaatctcgaaagccgatctcagttcggattggagtctgcaactcgactctatgaagctggaatcgctagtaatcgcgcatcagccatggcgcggtgaatacgttcccgggccttgtacacaccgcccgtcaaacaatggaagctgggggtgcctgaagtcggtaaccgcaaggagctgcctagggtaaaactagtaactggtgttaagtcgtaacaaggtagccgtaccggaaggtgcggctggaacatctcctttcta

SEQ ID NO: 4089 - DNA, 1526 bp, Glaciihabitans tibetensis
  ref <308>: DATABASE ACCESSION NUMBER: NCBI ACCESSION: NZ_PVTL01000016.1
  ref <309>: DATABASE ENTRY DATE: 2019-04-01
  ref <313>: RELEVANT RESIDUES IN SEQ ID NO: (1)..(1526)
tttatggagagtttgatcctggctcaggatgaacgctggcggcgtgcttaacacatgcaagtcgaacgatgaagagagcttgctcttggattagtggcgaacgggtgagtaacacgtgagtaacctgcccttgactctgggataagcactggaaacggtgtctaataccggatacgagcttcagccgcatggctaggagttggaaagaattttggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaaactggaggctcaacctccagcctgcagtgggtacgggcagactagagtgcggtaggggagattggaattcctggtgtagcggtggaatgcgcagatatcaggaggaacaccaatggcgaaggcagatctctgggccgttactgacgctgaggagcgaaagcatggggagcgaacaggattagataccctggtagtccatgccgtaaacgttgggaactagatgtagggaccattccacggtttctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaaagttcagaaatgttctccccgcaaggtcggtatacaggtggtgcatggttgtcgtcagctcgtgtcgtgagatgttgggttaagtcccgcaacgagcgcaaccctcgttctatgttgccagcacgtaatggtgggaactcataggagactgccggggtcaactcggaggaaggtggggatgacgtcaaatcatcatgccccttatgtcttgggcttcacgcatgctacaatggccgatacaaagggctgcaataccgtgaggtggagcgaatcccaaaaagtcggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaacccgtaaggggaggagctgtcgaaggtgggattggtaattaggactaagtcgtaacaaggtagccgtaccggaaggtgcggctggatcacctcctttctaagga

SEQ ID NO: 4090 - DNA, 1556 bp, Globicatella sanguinis
  ref <308>: DATABASE ACCESSION NUMBER: NCBI ACCESSION: NZ_PKJD01000016.1
  ref <309>: DATABASE ENTRY DATE: 2019-04-01
  ref <313>: RELEVANT RESIDUES IN SEQ ID NO: (1)..(1556)
tttcatgagagtttgatcctggctcaggacgaacgctggcggcgtgcctaatacatgcaagtcgaacgaaccgcaacttgaacttgttctggttaaggttagtggcgcacgggtgagtaacacgtggggaacctgccctttagtgggggataacagtcggaaacgactgctaataccgcatagacaacttaaccgcctggttaagttgggaaaggtgctacggcatcattaaaggatggccccgcggtgcattagctagttggtaaggtaacggcttaccaaggcgatgatgcatagccgacctgagagggtgatcggccacattgggactgagacacggcccaaactcctacgggaggcagcagtagggaatcttccgcaatggacgcaagtctgacggagcaacgccgcgtgtgtgaagaaggttttcggatcgtaaagcactgttgttagagaagaacggctactagaggaaatgttagtagattgacggtatctaaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactggggaacttgagtgcagaagaggaaagcggaattccatgtgtagcggtgaaatgcgtagatatatggaggaacaccagtggcgaaagcggctttctggtctgtaactgacactgaggctcgaaagcgtggggagcgaacaggattagataccctggtagtccacgccgtaaacgatgagtgctaagtgttggagggtttccacccttcagtgctggcgttaacgcaataagcactccgcctggggagtacgaccgcaaggttgaaactcaaaggaattgacggggacccgcacaagcggtggagcatgtggtttaattcgaagcaacgcgaagaaccttaccaggtcttgacatctcttgcatatcttagagataagagaaaccctacggggcaagaagacaggtggtgcatggttgtcgtcagctcgtgtcgtgagatgttgggttaagtcccgcaacgagcgcaacccttataactagttgccagcattgagatggggactctagttagactgccggtgacaaaccggaggaaggtggggatgacgtcaaatcatcatgccccttatgacctgggctacacacgtgctacaatggatggtacaacgagtcgctaactcgcaagagcatgccaatctctaaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacccgaagccggtggcctaaccaataggagggagccgtcgaaggtgggatggatgattggggtgaagtcgtaacaaggtagccgtatcggaaggtgcggctggatcacctcctttctaagga

SEQ ID NO: 4091 - DNA, 1555 bp, Globicatella sp. HMSC072A10
  ref <308>: DATABASE ACCESSION NUMBER: NCBI ACCESSION: NZ_KV805611.1
  ref <309>: DATABASE ENTRY DATE: 2019-04-01
  ref <313>: RELEVANT RESIDUES IN SEQ ID NO: (1)..(1555)
ttcatgagagtttgatcctggctcaggacgaacgctggcggcgtgcctaatacatgcaagtcgaacgaaccgcaacgagaacttgttctggttaaggttagtggcgcacgggtgagtaacacgtggggaacctgccctttagtgggggataacagtcggaaacgactgctaataccgcatagacaatttaaccgcctggttaagttgggaaaggtgctacggcatcattaaaggatggccccgcggtgcattagctagttggtaaggtaacggcttaccaaggcgatgatgcatagccgacctgagagggtgatcggccacattgggactgagacacggcccaaactcctacgggaggcagcagtagggaatcttccgcaatggacgcaagtctgacggagcaacgccgcgtgtgtgaagaaggttttcggatcgtaaagcactgttgttagagaagaacggctactagaggaaatgttagtagattgacggtatctaaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactggggaacttgagtgcagaagaggaaagcggaattccatgtgtagcggtgaaatgcgtagatatatggaggaacaccagtggcgaaagcggctttctggtctgtaactgacactgaggctcgaaagcgtggggagcgaacaggattagataccctggtagtccacgccgtaaacgatgagtgctaagtgttggagggtttccacccttcagtgctggcgttaacgcaataagcactccgcctggggagtacgaccgcaaggttgaaactcaaaggaattgacggggacccgcacaagcggtggagcatgtggtttaattcgaagcaacgcgaagaaccttaccaggtcttgacatctcttgcatatcttagagataagagaaacccttcggggcaagaagacaggtggtgcatggttgtcgtcagctcgtgtcgtgagatgttgggttaagtcccgcaacgagcgcaacccttataactagttgccagcattcagatggggactctagttagactgccggtgacaaaccggaggaaggtggggatgacgtcaaatcatcatgccccttatgacctgggctacacacgtgctacaatggatggtacaacgagtcgctaactcgcaagagcatgccaatctctaaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacccgaagccggtggcctaaccaattggagggagccgtcgaaggtgggatggatgattggggtgaagtcgtaacaaggtagccgtatcggaaggtgcggctggatcacctcctttctaagga

SEQ ID NO: 4092 - DNA, 1555 bp, Globicatella sulfidifaciens
  ref <308>: DATABASE ACCESSION NUMBER: NCBI ACCESSION: NZ_FUWO01000039.1
  ref <309>: DATABASE ENTRY DATE: 2019-04-01
  ref <313>: RELEVANT RESIDUES IN SEQ ID NO: (1)..(1555)
ttcatgagagtttgatcctggctcaggacgaacgctggcggcgtgcctaatacatgcaagtcgaacgaaccgcgacgagaacttgttctggtcaaggttagtggcgcacgggtgagtaacacgtggggaacctgccctttagtgggggataacagtcggaaacgactgctaataccgcatagacaatttaaccgcctggttaagttgggaaaggtgctacggcatcattaaaggatggccccgcggtgcattagctagttggtaaggtaacggcttaccaaggcgatgatgcatagccgacctgagagggtgatcggccacattgggactgagacacggcccaaactcctacgggaggcagcagtagggaatcttccgcaatggacgcaagtctgacggagcaacgccgcgtgtgtgaagaaggttttcggatcgtaaagcactgttgttagagaagaacggctactagaggaaatgctagtagattgacggtatctaaccagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactggggaacttgagtgcagaagaggaaagcggaattccatgtgtagcggtgaaatgcgtagatatatggaggaacaccagtggcgaaagcggctttctggtctgtaactgacactgaggctcgaaagcgtggggagcaaacaggattagataccctggtagtccacgccgtaaacgatgagtgctaagtgttggagggtttccacccttcagtgctggcgttaacgcaataagcactccgcctggggagtacgaccgcaaggttgaaactcaaaggaattgacggggacccgcacaagcggtggagcatgtggtttaattcgaagcaacgcgaagaaccttaccaggtcttgacatctcttgcatatcttagagataagagaaacccttcggggcaagaagacaggtggtgcatggttgtcgtcagctcgtgtcgtgagatgttgggttaagtcccgcaacgagcgcaacccttataactagttgccagcattcagatggggactctagttagactgccggtgacaaaccggaggaaggtggggatgacgtcaaatcatcatgccccttatgacctgggctacacacgtgctacaatggatggtacaacgagtcgctaactcgcaagagcatgccaatctctaaaagccattctcagttcggattgtagtctgcaactcgactacatgaagccggaatcgctagtaatcgcggatcagcacgccgcggtgaatacgttcccgggtcttgtacacaccgcccgtcacaccacgagagtttgtaacacccgaagccggtggcctaaccaataggagggagccgtcgaaggtgggatggatgattggggtgaagtcgtaacaaggtagccgtatcggaaggtgcggctggatcacctcctttctaagga

SEQ ID NO: 4093 - DNA, 1492 bp, Gloeobacter kilaueensis
  ref <308>: DATABASE ACCESSION NUMBER: NCBI ACCESSION: NC_022600.1
  ref <309>: DATABASE ENTRY DATE: 2019-04-01
  ref <313>: RELEVANT RESIDUES IN SEQ ID NO: (1)..(1492)
aaaatggagagtttgatcctggctcaggatgaacgctggcggcgtgcttaacacatgcaagtcgaacgagatcttcggatctagtggcggacgggtgagtaacacgtgggaatctgccctcaggagggggataacattcggaaacgagtgctaataccccatatgccgcaaggtgaaatgaatttcgcctgaggatgagcccgcgtctgattagctagttggtggggtaatggcctaccaaggcgacgatcagtagctggtctgagaggatgatcagccacactgggactgagacacggcccagactcctacgggaggcagcagtggggaattttccgcaatgggcgaaagcctgacggagcaacgccgcgtgggtgatgaaggcccgtgggtcgtaaaacccttttgtcagggacgaaacctgacggtacctgacgaataagcatcggctaactccgtgccagcagccgcggtaatacggaggatgcaagcgttatccggaattattgggcgtaaagcgtacgtaggtggccagccaagtctggggtcaaagcccgcagcctaactgcggaaaggccctggaaactggttggctagagtgcggtaggggcaaggggaattcccggtgtagcggtgaaatgtggagatatcgggaagaacaccagcggcgaaagcgccttgctggaccgcaactgacgctgaggtacgaaagccaggggagcaaatgggattagataccccagtagtcctggccgtaaacgttggacactaggtgttgcgcgtatcgacccgtgcagtgccgtagctaacgcgttaagtgtcccgcctggggagtacgcacgcaagtgtgaaactcaaaggaattgacgggggcccgcacaagcggtggagcatgtggtttaattcgatgcaacgcgaagaaccttaccagggcttgacatgtcgcgaacctcgcggaaacgtgggggtgccttcgggaacgcgaacacaggtgctgcatggctgtcgtcagctcgtgtcgtgagatgttgggttaagtcccgcaacgagcgcaaccctcgtcgtcagttgccatcattcagttgggcactctggcgagactgccggtgacaaaccggaggaaggtggggatgacgtcaagtcagcatggctcttacgtcctgggctacacacgtgctacaatggttcggataaagggctgcaatcccgcgagggggagccaatcccataaaccgaatctcagttcggattgtaggctgcaactcgcctacatgaagtcggaatcgctagtaatcgcaggtcagcatactgcggtgaatacgttcccgggccttgtacacaccgcccgtcacaccatgggagctggtcatgcccgaagtcggtatcctaaccgcaaggagggagccgccgaaggcggggccggtgactggggtgaagtcgtaacaaggtagccgtaccggaaggtgcggctggatcacctcctttctaggga

SEQ ID NO: 4094 - DNA, 1485 bp, Gloeobacter violaceus
  ref <308>: DATABASE ACCESSION NUMBER: NCBI ACCESSION: NC_005125.1
  ref <309>: DATABASE ENTRY DATE: 2019-04-01
  ref <313>: RELEVANT RESIDUES IN SEQ ID NO: (1)..(1485)
aaaatggagagtttgatcctggctcaggatgaacgctggcggcgtgcttaacacatgcaagtcgaacgagatcttcggatcgagtggcggacgggtgagtaacacgtgggaatctgccctcaggagggggataacggccggaaacggccgctaataccccatatgccgcaaggtgaaatgaatttcgcctgaggatgagcccgcgtctgattagctagttggtggggtaatggcctaccaaggctacgatcagtagctggtctgagaggatgatcagccacactgggactgagacacggcccagactcctacgggaggcagcagtggggaattttccgcaatgggcgaaagcctgacggagcaacgccgcgtgggtgatgaaggcccgtgggtcgtaaagcccttttgtcagggacgaaacctgacggtacctgacgaataagcatcggctaactccgtgccagcagccgcggtaatacggaggatgcaagcgttatccggaattattgggcgtaaagcgtacgtaggcggccagccaagtctggggtcaaagcccgcagcctaactgcggaaaggccctggaaactggttggctagagtgcggtaggggcaaggggaattcccggtgtagcggtgaaatgtggagatatcgggaagaacaccagcggcgaaagcgccttgctggaccgcaactgacgctgaggtacgaaagccaggggagcaaatgggattagataccccagtagtcctggccgtaaacgatggacactaggtgttgcgcgtatcgacccgtgcagtgccgtagctaacgcgttaagtgtcccgcctggggagtacgcacgcaagtgtgaaactcaaaggaattgacgggggcccgcacaagcggtggagcatgtggtttaattcgatgcaacgcgaagaaccttaccagggcttgacatgtcgcgaatctcgcggaaacgtgggagtgccttcgggaacgcgaacacaggtgctgcatggctgtcgtcagctcgtgtcgtgagatgttgggttaagtcccgcaacgagcgcaaccctcgtcgtcagttgccatcattcagttgggcactctggcgagactgccggtgacaaaccggaggaaggtggggatgacgtcaagtcagcatggctcttacgtcctgggctacacacgtgctacaatggttcggataaagggtcgcaatctcgcgagggggagccaatcccataaaccgaatctcagttcggattgcaggctgcaactcgcctgcatgaagtcggaatcgctagtaatcgcaggtcagcatactgcggtgaatacgttcccgggccttgtacacaccgcccgtcacaccatggaagctggtcatgcccgaagtcggtattctaaccgcaaggagggagccgccgaaggcggggccggtgactggggtgaagtcgtaacaaggtagccgtaccggaaggtgcggctggatcacctccttt

SEQ ID NO: 4095 - DNA, 1261 bp, Gloeocapsa sp. PCC 73106
  ref <308>: DATABASE ACCESSION NUMBER: NCBI ACCESSION: NZ_ALVY01000010.1
  ref <309>: DATABASE ENTRY DATE: 2019-04-01
  ref <313>: RELEVANT RESIDUES IN SEQ ID NO: (1)..(1261)
gctcaccaaggcgacgatcagtagctggtctgagaggatgatcagccacactgggactgagacacggcccagactcctacgggaggcagcagtggggaatcttccgcaatgggcgaaagcctgacggagcaataccgcgtgagggaggaaggtctaatagattgtaaacctcttttttcgggaaagaaaaaaatgacggtacccgaagaataagcatcggctaactccgtgccagcagccgcggtaatacggaggatgcaagcgttatccggaattattgggcgtaaagcgtccgcaggtggtactacaagtctactgtcaaagaccagagctcaactctgggcaggcggtggaaactgtaagactagagaccggtaggggtagagggaattcccagtgtagcggtgaaatgcgtagagattgggaagaacaccagtggcgaaggcgctctactgggccggaactgacactcagggacgaaagctaggggagcaaaagggattagatacccctgtagtcctagccgtaaacgatggatactaggcgtagcttgtatcaactcaagctgtgtcgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatggcgcgaatcccgccgaaaggtaggagtgccgcaaggaacgcgcacacaggtggtgcatggctgtcgtcagctcgtgtcgtgagatgttgggttaagtcccgcaacgagcgcaaccctcgtctttagttgccagcattaagatgggcactctagagagactgccggtgataagccggaggaaggtggggatgacgtcaagtcatcatgccccttacgtcctgggctacacacgtactacaatggtagggacaaagggcagcaagaccgcaaggtggagcgaatcccatcaaaccctgcctcagttcagattgcaggctgcaactcgcctgcatgaaggaggaatcgctagtaatcgcaggtcagcatactgcggtgaatccgttcccgggccttgtacacaccgcccgtcacaccatgggagcaagccacgcccgaagtcgttaccctaaccagtttctggagggggacgccgaaggcagggctagtgactggggtgaagtcgtaacaaggtagccgtaccggaaggtgtggctggatcacctcctttt

SEQ ID NO: 4096 - DNA, 1498 bp, Gloeocapsa sp. PCC 7428
  ref <308>: DATABASE ACCESSION NUMBER: NCBI ACCESSION: NC_019745.1
  ref <309>: DATABASE ENTRY DATE: 2019-04-01
  ref <313>: RELEVANT RESIDUES IN SEQ ID NO: (1)..(1498)
aaaacggagagtttgatcctggctcaggatgaacgctggcggtatgcttaacacatgcaagtcgaacggtgtcttcggacatagtggcggacgggtgagtaacgcgtgagaatctggcttaaggacggggacaaccactggaaacggtggctaagacccgatatgccgagaggtgaaagtatttttagccttgaggggagctcgcgtctgattagctagttggtggggtaagagcctaccaaggcgacgatcagtagctggtctgagaggatgatcagccacactgggactgagacacggcccagactcctacgggaggcagcagtggggaattttccgcaatgggcgaaagcctgacggagcaataccgcgtgggggaggaaggctcttgggttgtaaactccttttctcagggaagaaaaaaatgacggtacctgaggaatcagcatcggctaactccgtgccagcagccgcggtaatacggaggatgcaagcgttatccggaatcattgggcgtaaagcgtccgcaggtggcacttcaagtctgctgtcaaaggtcggggcttaactccgaacaggcagtggaaactgaagcgctcgagtgcggtaggggcagagggaattcctggtgtagcggtgaaatgcgtagagatcaggaagaacaccggtggcgaaagcgctctgctaggccgcaactgacactcagggacgaaagctaggggagcgaatgggattagataccccagtagtcctagctgtaaacgatggatactaggcgttgcttgtatcgacccaagcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggtttgacatgtccggaaccccactgaaaggtgggggtgccttcgggaaccggaacacaggtggtgcatggctgtcgtcagctcgtgtcgtgagatgttgggttaagtcccgcaacgagcgcaaccctcgtttttagttgccagcattaagttgggcactctagaaagactgccggtgacaaaccggaggaaggtggggatgacgtcaagtcagcatgccccttacgctctgggctacacacgtactacaatgctatggacaaagggcagcaagttagcgatgacaagcaaatcccataaaccatggctcagttcagatcgcaggctgcaactcgcctgcgtgaaggcggaatcgctagtaatcgccggtcagccatacggcggtgaatacgttcccgggccttgtacacaccgcccgtcacaccatggaagctggccacgcccgaagtcgttaccctaaccgcttgcggagggggacgccgaaggcagggctggtgactggggtgaagtcgtaacaaggtagccgtaccggaaggtgtggctggatcacctcctttttaggga

SEQ ID NO: 4097 - DNA, 1493 bp, Gloeocapsopsis sp. AAB1 1H9
  ref <308>: DATABASE ACCESSION NUMBER: NCBI ACCESSION: NZ_PTJN01000097.1
  ref <309>: DATABASE ENTRY DATE: 2019-04-01
  ref <313>: RELEVANT RESIDUES IN SEQ ID NO: (1)..(1493)
aaaacggagagtttgatcctggctcaggatgaacgctggcggtatgcttaacacatgcaagtcgaacggtgtcttcggacatagtggcggacgggtgagtaacgcgtgagaatctggcttaaggacggggacaaccactggaaacggtggctaagacccgatatgccgagaggtgaaagtaaattagccttaaggggagctcgcgtctgattagctagttggtggggtaagagcctaccaaggcgacgatcagtagctggtctgagaggatgatcagccacactgggactgagacacggcccagactcctacgggaggcagcagtggggaattttccgcaatgggcgaaagcctgacggagcaataccgcgtgggggaggaaggctcttgggttgtaaactccttttctcagggaagaaaaaaatgacggtacctgaggaataagcatcggctaactccgtgccagcagccgcggtaatacggaggatgcaagcgttatccggaatcattgggcgtaaagcgtccgcaggtggcatttcaagtctgctgtcaaaggtcggggcttaacttcgaacaggcagtggaaactgagaagctagagtgcggtaggggcagagggaattcctggtgtagcggtgaaatgcgtagagatcaggaagaacaccggtggcgaaagcgctctgctaggccgcaactgacactcagggacgaaagctaggggagcgaatgggattagataccccagtagtcctagctgtaaacgatggatactaggcgttgcttgtatcgacccaagcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgcccggaatcttggggaaactcaagagtgcctacgggaaccgggacacaggtggtgcatggctgtcgtcagctcgtgtcgtgagatgttgggttaagtcccgcaacgagcgcaaccctcgtttttagttgccagcattaagttgggcactctagaaagactgccggtgacaaaccggaggaaggtggggatgacgtcaagtcagcatgccccttacgctctgggctacacacgtactacaatgctatggacaaagggcagcaagttagcgatgacaagcaaatcccataaaccatggctcagttcagatcgcaggctgcaactcgcctgcgtgaaggcggaatcgctagtaatcgccggtcagccatacggcggtgaatacgttcccgggccttgtacacaccgcccgtcacaccatggaagctggccacgcccgaagtcgttaccctaaccgcttgcggagggggatgccgaaggcagggctggtgactggggtgaagtcgtaacaaggtagccgtaccggaaggtgtggctggatcacctccttttta

SEQ ID NO: 4098 - DNA, 1494 bp, Gloeomargarita lithophora
  ref <308>: DATABASE ACCESSION NUMBER: NCBI ACCESSION: NZ_CP017675.1
  ref <309>: DATABASE ENTRY DATE: 2019-04-01
  ref <313>: RELEVANT RESIDUES IN SEQ ID NO: (1)..(1494)
attcacaatggagagtttgatcctggctcaggatgaacgctggcggcgtgcttaacacatgcaagtcgaacggggtagcaatacctagtggcggacgggtgagtaacgcgtgagaacctggcttgaggtgggggacaacagttggaaacgactgctaataccccatatgccgaggggtgaaagatttatcgccttaaggggggctcgcgtccgattagcttgttggtggggtaatggcctaccaaggcgacgatcggtagctggtttgagaggacgaccagccacactgggactgagacacggcccagactcctacgggaggcagcagtggggaattttccgcaatgggcgcaagcctgacggagcaacgccgcgtgtgggatgaaggcctgtgggttgtaaaccacttttctcagggacgaacacaatgacggtacctgaggaatcagcctcggctaactctgtgccagcagccgcggtaagacagaggaggcaagcgttatccggaattattgggcgtaaagcgtccgtaggtggtctagcaagtctggggttaaagcccggagcccaactccggatcggccttggaaactgccagactcgagtaaggtaggggttgcgggaattcccggtgtagcggtgaaatgcgtagatatcgggaagaacaccagcggcgaaagcgcgcaactgggccattactgacactgagggacgaaagctaggggagcgaatgggattagataccccagtagtcctagccgtaaacgatggtgactagatgtggctcgtattgacccgagccgtgtcgtagctaacgcgataagtcacccgcctggggagtacgcacgcaagtgtgaaactcaaaggaattgacgggggcccgcacaagcggtggagcatgtggattaattcgatgcaacgcgaagaaccttaccagggcttgacatcctgcgaaccccgctgaaaggtgggggtgccttcgggagcgcagagacaggtggtgcatggctgtcgtcagctcgtgtcgtgagatgttgggttaagtcccgcaacgagcgcaacccgcgtccttagttgccagcatttagttgggcactctggggagactgccggtgacaagccggaggaaggtgcggatgacgtcaagtcagcatgccccttaccgccctgggcgtcacacgtgctacaatggccagcacaaagggtagccagccagcgatggtgagccaatcccataaagttggtctcagttcagatcggagtctgcaactcgactccgtgaaggcggaatcgctagtaatcgcaggtcagccatactgcggtgaatacgttcccgggccttgtacacaccgcccgtcacaccatgggagctggccacgcccgaagtcgttactccaaccgcaaggaggggagcgccgaaggcagggctggtgactggggtgaagtcgtaacaaggtagccgtactggaaggtgcggctggatcacctcctttt

SEQ ID NO: 4099 - DNA, 1499 bp, Gluconacetobacter diazotrophicus
  ref <308>: DATABASE ACCESSION NUMBER: NCBI ACCESSION: NC_010125.1
  ref <309>: DATABASE ENTRY DATE: 2019-04-01
  ref <313>: RELEVANT RESIDUES IN SEQ ID NO: (1)..(1499)
atgaacctgagagtttgatcctggctcagagcgaacgctggcggcatgcttaacacatgcaagtcgcacgaacctttcggggttagtggcggacgggtgagtaacgcgtagggatctgtccatgggtgggggataactccgggaaactggagctaataccgcatgacacctgagggtcaaaggcgcgagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttggacagtcagatgtgaaattcctgggcttaacctgggggctgcatttgatacgtatagactagagtgtgagagagggttgtggaattcccagtgtagaggtgaaattcgtagatattgggaagaacaccggtggcgaaggcggcaacctggctcataactgacgctgaggcgcgaaagcgtggggagcaaacaggattagataccctggtagtccacgctgtaaacgatgtgtgctggatgttgggtggcttagcccctcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatggggaggctgcagtcagagatggctgtttcccgcaagggacctcctgcacaggtgctgcatggctgtcgtcagctcgtgtcgtgagatgttgggttaagtcccgcaacgagcgcaaccctcgcctttagttgccagcatgattgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagctgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccagcaatggggcgcagccgaccacggtcgggtcagcgactggggtgaagtcgtaacaaggtagccgtaggggaacctgcggctggatcacctcctttcaag

SEQ ID NO: 4100 - DNA, 760 bp, Gluconacetobacter entanii
  ref <308>: DATABASE ACCESSION NUMBER: NCBI ACCESSION: NZ_NKUF01000092.1
  ref <309>: DATABASE ENTRY DATE: 2019-04-01
  ref <313>: RELEVANT RESIDUES IN SEQ ID NO: (1)..(760)
tagataccctggtagtccacgctgtaaacgatgtgtgctggatgttgggtggcttggccattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccagcacgtctgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagcggatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4101 - DNA, 1495 bp, Gluconacetobacter sp. SXCC-1
  ref <308>: DATABASE ACCESSION NUMBER: NCBI ACCESSION: NZ_AFCH01000055.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgttacagtcagatgtgaaattcccgggcttaacctgggggctgcatttgatacgtgatgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtctgggtgggcactctaaaggaactgccggtgacaagccggaggaaggtggggatgacgtcaagtcctcatggcccttatgtcctgggctacacacgtgctacaatggcggtgacagtgggaagccaggtggtgacaccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4102 - DNA, 1489 bp, Gluconobacter albidus
  ref <308>: DATABASE ACCESSION NUMBER: NCBI ACCESSION: NZ_BEWL01000031.1
  ref <309>: DATABASE ENTRY DATE: 2019-04-01
  ref <313>: RELEVANT RESIDUES IN SEQ ID NO: (1)..(1489)
tgaacctgagagtttgatcctggctcagagcgaacgctggcggcatgcttaacacatgcaagtcgcacgaaggtttcggccttagtggcggacgggtgagtaacgcgtagggatctatccacgggtgggggacaacttcgggaaactggagctaataccgcatgatacctgagggtcaaaggcgcaagtcgcctgtggaggaacctgcgttcgattagctagttggtggggtaaaggcctaccaaggcgatgatcgatagctggtttgagaggatgatcagccacactgggactgagacacggcccagactcctacgggaggcagcagtggggaatattggacaatgggggaaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttggacagtcagatgtgaaatccccgggcttaacctgggaactgcatttgatacgtccagactagagttcgagagagggttgtggaattcccagtgtagaggtgaaattcgtagatattgggaagaacaccggtggcgaaggcggcaacctggctcgatactgacgctgaggcgcgaaagcgtggggagcaaacaggattagataccctggtagtccacgctgtaaacgatgtgtgctggatgttgggtaacttagttactcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgcatggggaggaccggttcagagatggacctttcttcggacctcccgcacaggtgctgcatggctgtcgtcagctcgtgtcgtgagatgttgggttaagtcccgcaacgagcgcaacccttgtctttagttgccagcactttcaggtgggcactctagagagactgccggtgacaagccggaggaaggtggggatgacgtcaagtcctcatggcccttatgtcctgggctacacacgtgctacaatggcggtgacagtgggaagctacatggtgacatggtgctgatctctaaaagccgtctcagttcggattgtactctgcaactcgagtacatgaaggtggaatcgctagtaatcgcggatcagcatgccgcggtgaatacgttcccgggccttgtacacaccgcccgtcacaccatgggagttggttcgaccttaagccggtgagcgaaccgcaaggacgcagccgaccacggacgggtcagcgactggggtgaagtcgtaacaaggtagccgtaggggaacctgcggctggatcacctcctttcaag

SEQ ID NO: 4103 - DNA, 1489 bp, Gluconobacter cerinus
  ref <308>: DATABASE ACCESSION NUMBER: NCBI ACCESSION: NZ_BEWM01000030.1
  ref <309>: DATABASE ENTRY DATE: 2019-04-01
  ref <313>: RELEVANT RESIDUES IN SEQ ID NO: (1)..(1489)
tgaacctgagagtttgatcctggctcagagcgaacgctggcggcatgcttaacacatgcaagtcgcacggatctttcgggatcagtggcggacgggtgagtaacgcgtagggatctatccatgggtgggggacaactccgggaaactggagctaataccgcatgatacctgagggtcaaaggcgcaagtcgcctgtggaggaacctgcgttcgattagctagttggtggggtaaaggcctaccaaggcgatgatcgatagctggtttgagaggatgatcagccacactgggactgagacacggcccagactcctacgggaggcagcagtggggaatattggacaatgggcgaaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttatgcagtcagatgtgaaatccccgggcttaacctgggaactgcatttgagacgcatagactagaggtcgagagagggttgtggaattcccagtgtagaggtgaaattcgtagatattgggaagaacaccggtggcgaaggcggcaacctggctcgatactgacgctgaggcgcgaaagcgtggggagcaaacaggattagataccctggtagtccacgctgtaaacgatgtgtgctggatgttgggtaacttagttactcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccaggacttgcatggggaggacgtactcagagatgggtatttcttcggacctcccgcacaggtgctgcatggctgtcgtcagctcgtgtcgtgagatgttgggttaagtcccgcaacgagcgcaacccttgtctttagttgccagcactttcaggtgggcactctagagagactgccggtgacaagccggaggaaggtggggatgacgtcaagtcctcatggcccttatgtcctgggctacacacgtgctacaatggcggtgacagtgggaagctacatggcgacatggtgctgatctctaaaagccgtctcagttcggattgtactctgcaactcgagtacatgaaggtggaatcgctagtaatcgcggatcagcatgccgcggtgaatacgttcccgggccttgtacacaccgcccgtcacaccatgggagttggttcgaccttaagccggtgagcgaaccgcaaggacgcagccgaccacggacgggtcagcgactggggtgaagtcgtaacaaggtagccgtaggggaacctgcggctggatcacctcctttcaag

SEQ ID NO: 4104 - DNA, 1489 bp, Gluconobacter frateurii
  ref <308>: DATABASE ACCESSION NUMBER: NCBI ACCESSION: NZ_BEWN01000009.1
  ref <309>: DATABASE ENTRY DATE: 2019-04-01
  ref <313>: RELEVANT RESIDUES IN SEQ ID NO: (1)..(1489)
tgaacctgagagtttgatcctggctcagagcgaacgctggcggcatgcttaacacatgcaagtcgcacggatctttcgggattagtggcggacgggtgagtaacgcgtagggatctatccatgggtgggggacaactccgggaaactggagctaataccgcatgatacctgagggtcaaaggcgcaagtcgcctgtggaggaacctgcgttcgattagctagttggtggggtaaaggcctaccaaggcgatgatcgatagctggtttgagaggatgatcagccacactgggactgagacacggcccagactcctacgggaggcagcagtggggaatattggacaatgggcgaaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggttgatgcagtcagatgtgaaatccccgggcttaacctgggaactgcatttgagacgcattgactagagttcgagagagggttgtggaattcccagtgtagaggtgaaattcgtagatattgggaagaacaccggtggcgaaggcggcaacctggctcgatactgacgctgaggcgcgaaagcgtggggagcaaacaggattagataccctggtagtccacgctgtaaacgatgtgtgctggatgttgggtaacttagttactcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgcatggggaggacgtactcagagatgggtatttcttcggacctcccgcacaggtgctgcatggctgtcgtcagctcgtgtcgtgagatgttgggttaagtcccgcaacgagcgcaacccttgtctttagttgccagcactttcaggtgggcactctagagagactgccggtgacaagccggaggaaggtggggatgacgtcaagtcctcatggcccttatgtcctgggctacacacgtgctacaatggcggtgacagtgggaagctatgtggtgacacagtgctgatctctaaaagccgtctcagttcggattgtactctgcaactcgagtacatgaaggtggaatcgctagtaatcgcggatcagcatgccgcggtgaatacgttcccgggccttgtacacaccgcccgtcacaccatgggagttggttcgaccttaagccggtgagcgaaccgcaaggacgcagccgaccacggacgggtcagcgactggggtgaagtcgtaacaaggtagccgtaggggaacctgcggctggatcacctcctttcaag

SEQ ID NO: 4105 - DNA, 1489 bp, Gluconobacter japonicus; identical to SEQ ID NO: 4104
  ref <308>: DATABASE ACCESSION NUMBER: NCBI ACCESSION: NZ_BEWO01000051.1
  ref <309>: DATABASE ENTRY DATE: 2019-04-01
  ref <313>: RELEVANT RESIDUES IN SEQ ID NO: (1)..(1489)

SEQ ID NO: 4106 - DNA, 1489 bp, Gluconobacter kondonii
  ref <308>: DATABASE ACCESSION NUMBER: NCBI ACCESSION: NZ_BEWP01000040.1
  ref <309>: DATABASE ENTRY DATE: 2019-04-01
  ref <313>: RELEVANT RESIDUES IN SEQ ID NO: (1)..(1489)
tgaacctgagagtttgatcctggctcagagcgaacgctggcggcatgcttaacacatgcaagtcgcacgaaggtttcggccttagtggcggacgggtgagtaacgcgtagggatctatccacgggtgggggacaacttcgggaaactggagctaataccgcatgatacctgagggtcaaaggcgcaagtcgcctgtggaggaacctgcgttcgattagctagttggtggggtaaaggcctaccaaggcgatgatcgatagctggtttgagaggatgatcagccacactgggactgagacacggcccagactcctacgggaggcagcagtggggaatattggacaatgggggaaaccctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttggacagtcagatgtgaaatccccgggcttaacctgggaactgcatttgatacgtccagactagagttcgagagagggttgtggaattcccagtgtagaggtgaaattcgtagatattgggaagaacaccggtggcgaaggcggcaacctggctcgatactgacgctgaggcgcgaaagcgtggggagcaaacaggattagataccctggtagtccacgctgtaaacgatgtgtgctggatgttgggtaacttagttactcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccaggacttgcatggggaggaccggttcagagatggacctttcttcggacctcccgcacaggtgctgcatggctgtcgtcagctcgtgtcgtgagatgttgggttaagtcccgcaacgagcgcaacccttgtctttagttgccagcactttcaggtgggcactctagagagactgccggtgacaagccggaggaaggtggggatgacgtcaagtcctcatggcccttatgtcctgggctacacacgtgctacaatggcggtgacagtgggaagctacatggtgacatggtgctgatctctaaaagccgtctcagttcggattgtactctgcaactcgagtacatgaaggtggaatcgctagtaatcgcggatcagcatgccgcggtgaatacgttcccgggccttgtacacaccgcccgtcacaccatgggagttggttcgaccttaagccggtgagcgaaccgcaaggacgcagccgaccacggacgggtcagcgactggggtgaagtcgtaacaaggtagccgtaggggaacctgcggctggatcacctcctttcaag

SEQ ID NO: 4107 - DNA, 1489 bp, Gluconobacter morbifer
  ref <308>: DATABASE ACCESSION NUMBER: NCBI ACCESSION: NZ_AGQV01000001.1
  ref <309>: DATABASE ENTRY DATE: 2019-04-01
  ref <313>: RELEVANT RESIDUES IN SEQ ID NO: (1)..(1489)
tgaacctgagagtttgatcctggctcagagcgaacgctggcggcatgcttaacacatgcaagtcgcacggacctttcggggttagtggcggacgggtgagtaacgcgtagggatctatccatgggtgggggacaacttcgggaaactggagctaataccgcatgacacctgagggtcaaaggcgcaagtcgcctgtggaggagcctgcgttcgattagctagttggtggggtaaaggcctaccaaggcgatgatcgatagctggtttgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggtttggacagtcagatgtgaaatccccgggcttaacctgggaactgcatttgatacgttcagactagagttcgagagagggttgtggaattcccagtgtagaggtgaaattcgtagatattgggaagaacaccggtggcgaaggcggcaacctggctcgatactgacgctgaggcgcgaaagcgtggggagcaaacaggattagataccctggtagtccacgctgtaaacgatgtgtgctggatgttgggtaacttggttactcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgcatggggaggctgtgtccagagatgggcatttcttcggacctcccgcacaggtgctgcatggctgtcgtcagctcgtgtcgtgagatgttgggttaagtcccgcaacgagcgcaacccttgtctttagttgccagcacgtctgggtgggcactctagagagactgccggtgacaagccggaggaaggtggggatgacgtcaagtcctcatggcccttatgtcctgggctacacacgtgctacaatggcggtgacagtgggaagctagatggtgacatcatgctgatctctaaaagccgtctcagttcggattgtactctgcaactcgagtgcatgaaggtggaatcgctagtaatcgcggatcagcatgccgcggtgaatacgttcccgggccttgtacacaccgcccgtcacaccatgggagttggttcgaccttaagtcggtgagcgaaccgcaaggacgcagccgaccacggacgggtcagcgactggggtgaagtcgtaacaaggtagccgtaggggaacctgcggctggatcacctcctttcaag

SEQ ID NO: 4108 - DNA, 1489 bp, Gluconobacter roseus
  ref <308>: DATABASE ACCESSION NUMBER: NCBI ACCESSION: NZ_LHZP01000006.1
  ref <309>: DATABASE ENTRY DATE: 2019-04-01
  ref <313>: RELEVANT RESIDUES IN SEQ ID NO: (1)..(1489)
tgaacctgagagtttgatcctggctcagagcgaacgctggcggcatgcttaacacatgcaagtcgcacgaaggtttcggccttagtggcggacgggtgagtaacgcgtagggatctatccacgggtgggggacaacttcgggaaactggagctaataccgcatgatacctgagggtcaaaggcgcaagtcgcctgtggaggaacctgcgttcgattagctagttggtggggtaaaggcctaccaaggcgatgatcgatagctggtttgagaggatgatcagccacactgggactgagacacggcccagactcctacgggaggcagcagtggggaatattggacaatgggcgaaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggttgttacagtcagatgtgaaatccccgggcttaacctgggaactgcatttgatacgtgacgactagagttcgagagagggttgtggaattcccagtgtagaggtgaaattcgtagatattgggaagaacaccggtggcgaaggcggcaacctggctcgatactgacgctgaggcgcgaaagcgtggggagcaaacaggattagataccctggtagtccacgctgtaaacgatgtgtgctggatgttgggaaacttagtttctcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgcatggggaggaccggttcagagatggacctttcttcggacctcccgcacaggtgctgcatggctgtcgtcagctcgtgtcgtgagatgttgggttaagtcccgcaacgagcgcaacccttgtctttagttgccagcactttcaggtgggcactctagagagactgccggtgacaagccggaggaaggtggggatgacgtcaagtcctcatggcccttatgtcctgggctacacacgtgctacaatggcggtgacagtgggaagctacatggtgacatggtgctgatctctaaaagccgtctcagttcggattgtactctgcaactcgagtacatgaaggtggaatcgctagtaatcgcggatcagcatgccgcggtgaatacgttcccgggccttgtacacaccgcccgtcacaccatgggagttggttcgaccttaagccggtgagcgaaccgcaaggacgcagccgaccacggacgggtcagcgactggggtgaagtcgtaacaaggtagccgtaggggaacctgcggctggatcacctcctttcaag

SEQ ID NO: 4109 - DNA, 1489 bp, Gluconobacter sp. DsW 056; identical to SEQ ID NO: 4102
  ref <308>: DATABASE ACCESSION NUMBER: NCBI ACCESSION: NZ_JOPF01000038.1
  ref <309>: DATABASE ENTRY DATE: 2019-04-01
  ref <313>: RELEVANT RESIDUES IN SEQ ID NO: (1)..(1489)

SEQ ID NO: 4110 - DNA, 1492 bp, Gluconobacter thailandicus
  ref <308>: DATABASE ACCESSION NUMBER: NCBI ACCESSION: NZ_LHZS01000043.1
  ref <309>: DATABASE ENTRY DATE: 2019-04-01
  ref <313>: RELEVANT RESIDUES IN SEQ ID NO: (1)..(1492)
attgaacctgagagtttgatcctggctcagagcgaacgctggcggcatgcttaacacatgcaagtcgcacggatctttcgggattagtggcggacgggtgagtaacgcgtagggatctatccacgggtgggggacaactccgggaaactggagctaataccgcatgatacctgagggtcaaaggcgcaagtcgcctgtggaggaacctgcgttcgattagctagttggtggggtaaaggcctaccaaggcgatgatcgatagctggtttgagaggatgatcagccacactgggactgagacacggcccagactcctacgggaggcagcagtggggaatattggacaatgggcgaaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggttgatgcagtcagatgtgaaatccccgggcttaacctgggaactgcatttgagacgcattgactagaggtcgagagagggttgtggaattcccagtgtagaggtgaaattcgtagatattgggaagaacaccggtggcgaaggcggcaacctggctcgatactgacgctgaggcgcgaaagcgtggggagcaaacaggattagataccctggtagtccacgctgtaaacgatgtgtgctggatgttgggtaacttagttactcagtgtcgaagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgcatggggaggacgtactcagagatgggtatttcttcggacctcccgcacaggtgctgcatggctgtcgtcagctcgtgtcgtgagatgttgggttaagtcccgcaacgagcgcaacccttgtctttagttgccagcactttcaggtgggcactctagagagactgccggtgacaagccggaggaaggtggggatgacgtcaagtcctcatggcccttatgtcctgggctacacacgtgctacaatggcggtgacagtgggaagctatgtggtgacacagtgctgatctctaaaagccgtctcagttcggattgtactctgcaactcgagtacatgaaggtggaatcgctagtaatcgcggatcagcatgccgcggtgaatacgttcccgggccttgtacacaccgcccgtcacaccatgggagttggttcgaccttaagccggtgagcgaaccgcaaggacgcagccgaccacggacgggtcagcgactggggtgaagtcgtaacaaggtagccgtaggggaacctgcggctggatcacctcctttcaagg

SEQ ID NO: 4111 - DNA, 1533 bp, Glutamicibacter halophytocola
tttatggagagtttgatcctggctcaggatgaacgctggcggcgtgcttaacacatgcaagtcgaacgatgaagcccagcttgctgggtggattagtggcgaacgggtgagtaacacgtgagtaacctgcccccgactttgggataagcccgggaaactgggtctaataccggatatgacttttcaccgcatggtgggttgttgaaagatttatcggtgggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccagaccgctccagagatggggtttcccttcggggctggttcacaggtggtgcatggttgtcgtcagctcgtgtcgtgagatgttgggttaagtcccgcaacgagcgcaaccctcgttccatgttgccagcacgtagtggtggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccaccttgtgtggggggagtcgtcgaaggtgggactggcgattgggactaagtcgtaacaaggtagccgtaccggaaggtgcggctggatcacctcctttctaagga

SEQ ID NO: 4112 - DNA, 1533 bp, Glutamicibacter halophytocola
tttatggagagtttgatcctggctcaggatgaacgctggcggcgtgcttaacacatgcaagtcgaacgatgaagcccagcttgctgggtggattagtggcgaacgggtgagtaacacgtgagtaacctgcccccgactttgggataagcccgggaaactgggtctaataccggatatgacttcctgccgcatggtgggttgttgaaagatttatcggtgggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccagaccgctccagagatggggtttcccttcggggctggttcacaggtggtgcatggttgtcgtcagctcgtgtcgtgagatgttgggttaagtcccgcaacgagcgcaaccctcgttccatgttgccagcacgtagtggtggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccaccttgtgtggggggagtcgtcgaaggtgggactggcgattgggactaagtcgtaacaaggtagccgtaccggaaggtgcggctggatcacctcctttctaagga

SEQ ID NO: 4113 - DNA, 1533 bp, Glutamicibacter halophytocola; identical to SEQ ID NO: 4111

SEQ ID NO: 4114 - DNA, 1533 bp, Glutamicibacter halophytocola; identical to SEQ ID NO: 4111

SEQ ID NO: 4115 - DNA, 1533 bp, Glutamicibacter halophytocola; identical to SEQ ID NO: 4112

SEQ ID NO: 4116 - DNA, 1533 bp, Glutamicibacter halophytocola; identical to SEQ ID NO: 4112

SEQ ID NO: 4117 - DNA, 1533 bp, Glutamicibacter halophytocola; identical to SEQ ID NO: 4112

SEQ ID NO: 4118 - DNA, 1533 bp, Glutamicibacter nicotianae
  ref <308>: DATABASE ACCESSION NUMBER: NCBI ACCESSION: NZ_CP033081.1
  ref <309>: DATABASE ENTRY DATE: 2019-04-01
  ref <313>: RELEVANT RESIDUES IN SEQ ID NO: (1)..(1533)
tttatggagagtttgatcctggctcaggatgaacgctggcggcgtgcttaacacatgcaagtcgaacgatgaagcccagcttgctgggtggattagtggcgaacgggtgagtaacacgtgagtaacctgcccccgactctgggataagcccgggaaactgggtctaataccggatatgacctcgcaccgcatggtgcggggtggaaagatttatcggtgggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccagaccgcctcagagatggggtttcccttcggggctggttcacaggtggtgcatggttgtcgtcagctcgtgtcgtgagatgttgggttaagtcccgcaacgagcgcaaccctcgttccatgttgccagcacgtagtggtggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccaccttgtgtggggggagtcgtcgaaggtgggactggcgattgggactaagtcgtaacaaggtagccgtaccggaaggtgcggctggatcacctcctttctaagga

SEQ ID NO: 4119 - DNA, 1533 bp, Glutamicibacter sp. HZAU
  ref <308>: DATABASE ACCESSION NUMBER: NCBI ACCESSION: NZ_SCKZ01000017.1
  ref <309>: DATABASE ENTRY DATE: 2019-04-01
  ref <313>: RELEVANT RESIDUES IN SEQ ID NO: (1)..(1533)
tttatggagagtttgatcctggctcaggatgaacgctggcggcgtgcttaacacatgcaagtcgaacgatgaagcccagcttgctgggtggattagtggcgaacgggtgagtaacacgtgagtaacctgcccccgactctgggataagcccgggaaactgggtctaataccggatatgaccatggaacgcatgttttgtggtggaaagatttatcggtgggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggatttattgggcgtaaagagctcgtaggcggtttgtcgcgtctgccgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgtgccagaccgcctcagagatggggtttcccttcggggctggttcacaggtggtgcatggttgtcgtcagctcgtgtcgtgagatgttgggttaagtcccgcaacgagcgcaaccctcgttccatgttgccagcacgtagtggtggggactcatgggagactgccggggtcaactcggaggaaggtggggatgacgtcaaatcatcatgccccttatgtcttgggcttcacgcatgctacaatggccggtacaatgggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccaccttgtgtggggggagtcgtcgaaggtgggactggcgattgggactaagtcgtaacaaggtagccgtaccggaaggtgcggctggatcacctcctttctaagga

SEQ ID NO: 4120 - DNA, 1471 bp, Glycocaulis alkaliphilus
  ref <308>: DATABASE ACCESSION NUMBER: NCBI ACCESSION: NZ_CP018911.1
  ref <309>: DATABASE ENTRY DATE: 2019-04-01
  ref <313>: RELEVANT RESIDUES IN SEQ ID NO: (1)..(1471)
caacctgagagtttgattctggctcagaacgaacgctggcggaaggcttaacacatgcaagtcgagcgcacccttcggggtgagcggcagacgggtgagtaacgcgtgggaacgtgccctttggttcggaatagcctcgggaaactgggagtaataccgaatgtgcccttcgggggaaagatttatcgccaaaggatcggcccgcgttagattagcttgttggtggggtaatggcccaccaaggcgacgatctatagctggtctgagaggatgatcagccacactgggactgagacacggcccagactcctacgggaggcagcagtggggaatcttggacaatgggcgaaagcctgatccagccattccgcgtggatgatgaaggccttagggttgtaaaatcctttcagcggggaagataatgactgtacccgcagaagaagccccggctaactccgtgccagcagccgcggtaatacggagggggctagcgttgttcggaattactgggcgtaaagcgcacgtaggcggatcagccagtcagaggtgaaagcccagggctcaaccttggaattgcctttgatactgttgatctggagtccgggagaggtgtgtggaattccgagtgtagaggtgaaattcgtagatattcggaggaacaccagaggcgaaggcgacacactggaccggtactgacgctgaggtgcgaaagcgtggggagcaaacaggattagataccctggtagtccacgccgtaaacgatggatgctagttgtcgggcagcatgctgttcggtgacgcagctaacgcattaagcatcccgcctggggagtacggccgcaaggttaaaactcaaagaaattgacgggggcccgcacaagcggtggagcatgtggtttaattcgaagcaacgcgcagaaccttacctgcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgtcgttagttgccatcaggttgggctgggcactctaacgagactgccggtgtcaaaccggaggaaggtggggatgacgtcaagtcctcatggcccttacgggcagggctacacacgtgctacaatggcagtgacagagagttaatctctaaaagctgtctcagttcggattgttctctgcaactcgagagcatgaagttggaatcgctagtaatcgcggatcagcatgccgcggtgaatacgttcccgggccttgtacacaccgcccgtcacaccatgggagttggttctacccgaagatggtgcgctaaccgcaaggaagcagccagccacggtagggtcagcgactggggtgaagtcgtaacaaggtagccgtaggggaacctgcggctggatcacctcctttctaa

SEQ ID NO: 4121 - DNA, 1539 bp, Glycomyces sp. YIM 121974
  ref <308>: DATABASE ACCESSION NUMBER: NCBI ACCESSION: NZ_RSEB01000013.1
  ref <309>: DATABASE ENTRY DATE: 2019-04-01
  ref <313>: RELEVANT RESIDUES IN SEQ ID NO: (1)..(1539)
tgttggagagtttgatcctggctcaggacgaacgctggcggcgtgcttcacacatgcaagtcgaacggaaaggccctttcgggggtgctcgagtggcgaacgggtgagtaacacgtgggtaacctgcccccatctctgggataaccgttggaaacggcggctaataccggatacgaccttggcacgcatgtgtcttggtggaaagcttttgtggttggggaggggcccgcggcctatcagctggttggtggggtgatggcctaccaaggcggtgacgggtagccggcctgagagggcggtcggtcacattgggactgagatacggcccagactcctacgggaggcagcagtggggaattttgcacaatgggcggaagcctgatgcagcgacgccgcgtgagggatgacggctttcgggttgtaaacctcttttatccaccacgaaggccaggtattcgcctggttgacggtagtggttgaataagcgccggctaactacgtgccagcagccgcggtaagacgtagggcgcgagcgttgtccggatttattgggcgtaaagggctcgtaggcggcccgctgcgtctgccgtgaaaggcatcggcttaaccggtgttttgcggtggatacgggcgggcttgaggcaagtaggggaaactggaattctacgtgtagcggtgaaatgcgcagatatgtggaggaacaccggtggcgaaggcgggtttctgggcttgttctgacgctgaggagcgaaagcgtggggagcgaacaggattagataccctggtagtccatgctgtaaacggtgggcgctaggtgtggggccacgttggttggttctgtgccgtagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatcacccggaaagctctagagatagggccctcttcggactgggtgacaggtggtgcatggctgtcgtcagctcgtgtcgtgagatgttgggttaagtcccgcaacgagcgcaacccttatcccgtgttgccagcattcagttggggactcgcgggagactgccggggttaactcggaggaaggtggggatgaggtcaagtcatcatgccccttatgtccagggcttcacgcatgctacattggccggtacagcgggttgcgataccgtgaggtggagcgaatctctgtaaagccggtcttggttcggattcgagtctgcaactcgactcgatgaaggtggagtcgctagtaatcgcagatcagcaacgctgcggtgaatgcgttcccgggccttgtacacaccgcccgtcacgtcatgaaagttggcaacacccgaagcctgcggcctaaccggtttaccggagggagtggtcgaaggtggggctggcgattaggacgaagtcgtaacaaggtagccgtaccggaaggtgcggctggatcacctcctttctaaggag

SEQ ID NO: 4122 - DNA, 1528 bp, Gordonia alkanivorans
  ref <308>: DATABASE ACCESSION NUMBER: NCBI ACCESSION: NZ_CP027114.1
  ref <309>: DATABASE ENTRY DATE: 2019-04-01
  ref <313>: RELEVANT RESIDUES IN SEQ ID NO: (1)..(1528)
tttcatggagagtttgatcctggctcaggacgaacgctggcggcgtgcttaacacatgcaagtcgaacggaaaggcccagcttgctgggtactcgagtggcgaacgggtgagtaacacgtgggtgatctgccctgaactttgggataagcctgggaaactgggtctaataccggatatgaccttggagtgcatgctctggggtggaaagcttttgcggttcaggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcaccagggacgaagcgcaagtgacggtacctggagaagaagcaccggccaactacgtgccagcagccgcggtaatacgtagggtgcgagcgttgtccggaattactgggcgtaaagagctcgtaggcggtttgtcgcgtcgtctgtgaaattctgcaactcaattgtaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtggggctcatttcacgagttccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcatgtagagatacatgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggctggtacagagggctgcgataccgtgaggtggagcgaatcccttaaagccagtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggatcggcgattgggacgaagtcgtaacaaggtagccgtaccggaaggtgcggctggatcacctcctttctaa

SEQ ID NO: 4123 - DNA, 1522 bp, Gordonia phthalatica
  ref <308>: DATABASE ACCESSION NUMBER: NCBI ACCESSION: NZ_CP011853.1
  ref <309>: DATABASE ENTRY DATE: 2019-04-01
  ref <313>: RELEVANT RESIDUES IN SEQ ID NO: (1)..(1522)
ttggagagtttgatcctggctcaggacgaacgctggcggcgtgcttaacacatgcaagtcgaacggaaaggccccttcgggggtactcgagtggcgaacgggtgagtaacacgtgggtgatctgccctgaactctgggataagcctgggaaactgggtctaataccggatatgacctcgcatcgcatggtgtggggtggaaagcttttgcggtttgggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcgccagggacgaagcgcaagtgacggtacctggagaagaagcaccggccaactacgtgccagcagccgcggtaatacgtagggtgcgagcgttgtccggaattactgggcgtaaagagctcgtaggcggtttgtcgcgtcgtctgtgaaattctgcaactcaattgcaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtggggagcgaacaggattagataccctggtagtccacgccgtaaacggtgggtactaggtgtggggctcatttcacgagttccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcagtcagagatggctgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggcgcgtacagagggctgcgagaccgtaaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggatcggcgattgggacgaagtcgtaacaaggtagccgtaccggaaggtgcggctggatcacctcctttctaa

SEQ ID NO: 4124 - DNA, 1526 bp, Gordonia rubripertincta
  ref <308>: DATABASE ACCESSION NUMBER: NCBI ACCESSION: NZ_CP022580.1
  ref <309>: DATABASE ENTRY DATE: 2019-04-01
  ref <313>: RELEVANT RESIDUES IN SEQ ID NO: (1)..(1526)
tttcatggagagtttgatcctggctcaggacgaacgctggcggcgtgcttaacacatgcaagtcgaacggaaaggcccagcttgctgggtactcgagtggcgaacgggtgagtaacacgtgggtgatctgccctggactctgggataagcctgggaaactgggtctaataccggatatgaccttacatcgcatggtgtttggtggaaagcttttgcggttcaggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcaccagggacgaagcgtgagtgacggtacctggagaagaagcaccggccaactacgtgccagcagccgcggtaatacgtagggtgcgagcgttgtccggaattactgggcgtaaagagctcgtaggcggtttgtcgcgtcgtctgtgaaattctgcaactcaattgtaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtggggctcatttcacgagttccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcatgtagagatacatgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggctggtacagagggctgcgataccgtgaggtggagcgaatcccttaaagccagtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagctgtcgaaggtgggatcggcgattgggacgaagtcgtaacaaggtagccgtaccggaaggtgcggctggatcacctcctttctaa

SEQ ID NO: 4125 - DNA, 1528 bp, Gordonia sp. AMA120
  ref <308>: DATABASE ACCESSION NUMBER: NCBI ACCESSION: NZ_RZUM01000014.1
  ref <309>: DATABASE ENTRY DATE: 2019-04-01
  ref <313>: RELEVANT RESIDUES IN SEQ ID NO: (1)..(1528)
tttcatggagagtttgatcctggctcaggacgaacgctggcggcgtgcttaacacatgcaagtcgaacggaaaggcccgcttgcgggtactcgagtggcgaacgggtgagtaacacgtgggtgatctgcccctgactttgggataagcctgggaaactgggtctaataccggatattcactttctcctgcatgggggttggtggaaagcttttgcggttggggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcagcagggacgaagcttttgtgacggtacctgcagaagaagcaccggccaactacgtgccagcagccgcggtaatacgtagggtgcgagcgttgtccggaattactgggcgtaaagagctcgtaggcggtttgtcgcgtcgtctgtgaaattctgcagcttaactgtaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtgggttccttttcacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagatgctggtagagatatcagttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccctttgtgggagggagctgtcgaaggtgggatcggcgattgggacgaagtcgtaacaaggtagccgtaccggaaggtgcggctggatcacctcctttctaa

SEQ ID NO: 4126 - DNA, 1526 bp, Gordonia sp. MMS17-SY073
  ref <308>: DATABASE ACCESSION NUMBER: NCBI ACCESSION: NZ_CP033972.1
  ref <309>: DATABASE ENTRY DATE: 2019-04-01
  ref <313>: RELEVANT RESIDUES IN SEQ ID NO: (1)..(1526)
tttcatggagagtttgatcctggctcaggacgaacgctggcggcgtgcttaacacatgcaagtcgaacggaaaggcccagcttgctgggtactcgagtggcgaacgggtgagtaacacgtgggtgatctgccccaaactttgggataagcctgggaaactgggtctaataccggatatgaccatgggatgcatgttctgtggtggaaagcttttgcggtttgggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcaccagggacgaagcgtgagtgacggtacctggagaagaagcaccggccaactacgtgccagcagccgcggtaatacgtagggtgcaagcgttgtccggaattactgggcgtaaagagctcgtaggcggtttgtcgcgtcgtctgtgaaattctgcaactcaattgcaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtgggttccttttcacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgcatacagagatgtatgttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagctgtcgaaggtgggatcggcgattgggacgaagtcgtaacaaggtagccgtaccggaaggtgcggctggatcacctcctttctaa

SEQ ID NO: 4127 - DNA, 1529 bp, Gordonia sp. RS15-1S
  ref <308>: DATABASE ACCESSION NUMBER: NCBI ACCESSION: NZ_RKMH01000030.1
  ref <309>: DATABASE ENTRY DATE: 2019-04-01
  ref <313>: RELEVANT RESIDUES IN SEQ ID NO: (1)..(1529)
tttcatggagagtttgatcctggctcaggacgaacgctggcggcgtgcttaacacatgcaagtcgaacggaaaggcctagcttgctaggtgctcgagtggcgaacgggtgagtaacacgtgggtgatctgcccctgactttgggataagcctgggaaactgggtctaataccggatatgaccatgggatgcatgttctgtggtggaaagccttgtgcggttggggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcagcagggacgaagcttttgtgacggtacctgcagaagaagcaccggccaactacgtgccagcagccgcggtaatacgtagggtgcgagcgttgtccggaattactgggcgtaaagagctcgtaggcggtttgtcgcgtcgtctgtgaaattctgcagcttaactgcaggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtgggttccatttcacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgccagcagagatgttggttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggatcggcgattgggacgaagtcgtaacaaggtagccgtaccggaaggtgcggctggatcacctcctttctaa

SEQ ID NO: 4128 - DNA, 971 bp, Gordonibacter faecihominis
  ref <308>: DATABASE ACCESSION NUMBER: NCBI ACCESSION: NZ_QIBV01000021.1
  ref <309>: DATABASE ENTRY DATE: 2019-04-01
  ref <313>: RELEVANT RESIDUES IN SEQ ID NO: (1)..(971)
aacggagagtttgatcctggctcaggatgaacgctggcggcgtgcctaacacatgcaagtcgaacgattaaggcgccttcgggcgtgtatagagtggcgaacgggtgagtaacacgtgaccaacctgcccccctccccgggataacgcgaggaaacccgcgctaataccggatactccgcccctcccgcatgggaggggcgggaaagccccgacggagggggatggggtcgcggcccattaggtagacggcggggcaacggcccaccgtgcctgcgatgggtagccgggttgagagaccgaccggccacattgggactgagatacggcccagactcctacgggaggcagcagtggggaattttgcgcaatggggggaaccctgacgcagcaacgccgcgtgcgggacgaaggccttcgggttgtaaaccgctttcagcagggaagaagttgacggtacctgcagaagaagccccggctaactacgtgccagcagccgcggtaatacgtagggggcgagcgttatccggattcattgggcgtaaagcgcgcgtaggcggcccgtcaagcggaacctctaacccgagggctcaacccccggtcgggttccgaactggcaggctcgagtttggtagaggaagatggaattcccggtgtagcggtggaatgcgcagatatcgggaagaacaccgatggcgaaggcagtcttctgggccatcaactgacgctgaggcgcgaaagctgggggagcgaacaggattagataccctggtagtcccagccgtaaacgatgggtgctaggtgtggggggatcatccctccgtgccgcagccaacgcattaagcaccccgcctggggagtacggccgcaaggctaaaactcaaaggaattgacgggggcccgcacaagcagcggagcatgtggcttaattcgaagcaacgcgaagaaccttaccagggcttgacatgctggt

SEQ ID NO: 4129 - DNA, 1521 bp, Gordonibacter sp. Marseille-P4307
  ref <308>: DATABASE ACCESSION NUMBER: NCBI ACCESSION: NZ_UWPD01000001.1
  ref <309>: DATABASE ENTRY DATE: 2019-04-01
  ref <313>: RELEVANT RESIDUES IN SEQ ID NO: (1)..(1521)
ttcgaacggagagttcgatcctggctcaggatgaacgctggcggcgtgcctaacacatgcaagtcgaacggttaagacggcttcggccgtgaatagagtggcgaacgggtgagtaacacgtgaccaacctgccctccgcaccgggacaaccgggggaaaccccggctaataccggacgatcccggccccccgcatggggggccgggcgaagcccaggcggcgggggatggggtcgcggcccattaggtagacggcggggcaacggcccaccgtgccgacgatgggtagccgggttgagagaccgaccggccacattgggactgagatacggcccagactcctacgggaggcagcagtggggaatattgcgcaatgggggcaaccctgacgcagcaacgccgcgtgcgggacgacggccttcgggttgtaaaccgctttcagcagggaagatagtgacggtacctgcacaagaagccccggctaactacgtgccagcagccgcggtaatacgtagggggcgagcgttatccggattcattgggcgtaaagcgcgcgcaggcggctcttcaagcggaacctctaaccccggggctcaacctcgggccgggttccgaactggagggctcgagtgcggtagaggcaggcggaattcccggtgtagcggtggaatgcgcagatatcgggaagaacaccgatggcgaaggcagcctgctgggccggcactgacgctgaggcgcgaaagctaggggagcgaacaggattagataccctggtagtcctagccgtaaacgatgatcgctaggtgtggggggagccttccccccgtgccgaagccaacgcattaagcgatccgcctggggagtacggccgcaaggctaaaactcaaaggaattgacgggggcccgcacaagcagcggagcatgtggcttaattcgaagcaacgcgaagaaccttaccagggcttgacatgcaggtgaagcggcggaaacgccgtggccgagaggagcctgcgcaggtggtgcatggctgtcgtcagctcgtgtcgtgagatgttgggttaagtcccgcaacgagcgcaacccctgccccgtgttgccagcattcagttggggactcgcgggggactgccggtgacaaaccggaggaaggcggggacgacgtcaagtcatcatgccccttatgccctgggccgcacacgtgctacaatggccggcacagcgggctgccacccagcgatggggagcgaatcccgtaaagccggccccagttcggatcggaggctgcaacccgcctccgtgaagccggagttgctagtaatcgcggatcagcacgccgcggtgaatgcgttcccgggccttgtacacaccgcccgtcacaccacccgagtcgtctgcacccgaagccgccggccgaaccccgcgagggggcggaggcgtcgaaggtgtggagggtgaggggggtgaagtcgtaacaaggtagccgtaccggaaggtgcggctggatcacctcctttctagggag

SEQ ID NO: 4130 - DNA, 1553 bp, Gorillibacterium massiliense
  ref <308>: DATABASE ACCESSION NUMBER: NCBI ACCESSION: NZ_CBQR020000178.1
  ref <309>: DATABASE ENTRY DATE: 2019-04-01
  ref <313>: RELEVANT RESIDUES IN SEQ ID NO: (1)..(1553)
tggagagtttgatcctggctcaggacgaacgctggcggcgtgcctaatacatgcaagtcgagcggatcttgtccttcgggataaggttagcggcggacgggtgagtaacacgtaggcaacctgccgataagactgggataacctccggaaacggaagctaagaccggatacgttgatttctcgcatgagaggatcatggaaagacggagcaatctgtcacttatcgatgggcctgcggcgcattagctagtaggtggggtaatggctcacctaggcgacgatgcgtagccgacctgagagggtgaacggccacactgggactgagacacggcccagactcctacgggaggcagcagtagggaatcttcggcaatggacgcaagtctgaccgagcaacgccgcgtgagtgaagaagggtttcggctcgtaaaactctgttgccaaggaagaacgctggatagagtaactgctattcaggtgacggtacttgagaagaaagccccggctaactacgtgccagcagccgcggtaatacgtagggggcaagcgttgtccggaattattgggcgtaaagcgcgcgcaggcggttttttaagtctggagtttaaacctggggctcaacctcgggtcgctctggaaactggggaactggagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatgctaggtgttaggggtttcgatacccttggtgccgaagtaaacacagtaagcatgccgcctggggagtacgctcgcaagagtgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttgaacttagttgccagcattgagttgggcactctaagttgactgccggtgacaaaccggaggaaggcggggatgacgtcaaatcatcatgccccttatgacctgggctacacacgtactacaatggccggtacaacggggagcgaaagagcgatctggagcgaatctttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctagggag

SEQ ID NO: 4131 - DNA, 1569 bp, Gorillibacterium timonense
  ref <308>: DATABASE ACCESSION NUMBER: NCBI ACCESSION: NZ_LN881720.1
  ref <309>: DATABASE ENTRY DATE: 2019-04-01
  ref <313>: RELEVANT RESIDUES IN SEQ ID NO: (1)..(1569)
cttttatggagagtttgatcctggctcaggacgaacgctggcggcgtgcctaatacatgcaagtcgagcggagtttacttgaatcttcggatgaaggtaagcttagcggcggacgggtgagtaacacgtaggcaacctgccctcaagactgggataacctccggaaacggaagctaagaccggatacgttctttctgccgcatggtggggagaagaaaagcggagcaatctgctacttgaggatgggcctgcggcgcattagctagtaggtgaggtaatggctcacctaggcgacgatgcgtagccgacctgagagggtgaacggccacactgggactgagacacggcccagactcctacgggaggcagcagtagggaatcttcggcaatggacgaaagtctgaccgagcaacgccgcgtgagtgaagaagggtttcggctcgtaaaactctgttgccaaggaagaagggtaaggagagtaactgctctttgcttgacggtacttgagaagaaagccccggctaactacgtgccagcagccgcggtaatacgtagggggcaagcgttgtccggaattattgggcgtaaagcgcgcgcaggcggtcttttaagtctggggtataaacgcagggctcaaccctgtgtcgccttggaaactgggagactggagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgcatgctaggtgttaggggtttcgatacccttggtgccgaagtaaacacagtaagcatgccgcctggggagtacgctcgcaagagtgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtactacaatggccggtacaacgggaagcgaagccgcgaggtggagcgaatctttagaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctagggag

SEQ ID NO: 4132 - DNA, 1531 bp, Gottschalkia acidurici
  ref <308>: DATABASE ACCESSION NUMBER: NCBI ACCESSION: NC_018664.1
  ref <309>: DATABASE ENTRY DATE: 2019-04-01
  ref <313>: RELEVANT RESIDUES IN SEQ ID NO: (1)..(1531)
ttttattttgagagtttgatcctggctcaggatgaacgctggcggcgtgcctaacacatgcaagtcgagcgggaaagtcgttacggatccttcgggtgaaagagtgactggagagcggcggaccggtgagtaacgcgtgggaaaccttccttatacaaagggatagcctcgggaaaccgggattaataccttataaaactctagcaccacatggtgcatgagtcaaaactccggtggtataagatggtccctcgtcccaattagctagttggtgagataaaagctcaccaaggcgacgatgggtagccggcctgagagggtgaacggccacactggaactgagacacggtccagactcctacgggaggcagcagtggggaatattgcacaatgggggaaaccctgatgcagcgacgccgcgtgagtgatgaaggcctttgggtcgtaaaactctgtcctaagggaagataatgacggtaccttaggaggaagccccggctaactacgtgccagcagccgcggtaatacgtagggggcgagcgttatccggaattattgggcgtaaagggtgcgtaggcggccaaataagtcaggtgtgaaaggcgtcggctcaaccggcgtaagcacttgaaactatttggcttgagtacaggagaggaaagtggaattcctagtgtagcggtgaaatgcgtagatattaggaggaacaccagtggcgaaggcgactttctggactgatactgacgctgaggcacgaaagcgtggggagcgaacaggattagataccctggtagtccacgccgtaaacgatgagtgctaggtgttgggggtcgaacctcagtgccgcagctaacgcattaagcactccgcctggggagtacggtcgcaagactgaaactcaaaggaattgacggggacccgcacaagcagcggagcatgtggtttaattcgaagcaacgcgaagaaccttaccaacatttgacatccctctgacaactctagagatagagtctcccttcggggcagaggtgacaggtggtgcatggttgtcgtcagctcgtgtcgtgagatgttgggttaagtcccgcaacgagcgcaacccttacctttagttgccatcattaagttgggcactctagagggactgccgatgataaatcggaggaaggtggggatgacgtcaaatcatcatgccccttatatgttgggctacacacgtgctacaatggtcggtacaacgggcagcgaaaccgcgaggtggagcgaatctcaataagccgatcacagttcggattgtaggctgcaactcgcctacatgaagccggagttgctagtaatcgcggatcagaatgtcgcggtgaatacgttcccgggtcttgtacacaccgcccgtcacaccacgagagttggtaacacccgaagccagtgagctaaccgcaaggaggcagctgtcgaaggtgggatcgatgattggggtgaagtcgtaacaaggtagccgtatcggaaggtgcggctggatcacctcctttct

SEQ ID NO: 4133 - DNA, 866 bp, Gottschalkia purinilytica
  ref <308>: DATABASE ACCESSION NUMBER: NCBI ACCESSION: NZ_LGSS01000012.1
  ref <309>: DATABASE ENTRY DATE: 2019-04-01
  ref <313>: RELEVANT RESIDUES IN SEQ ID NO: (1)..(866)
tttaatttgagagtttgatcctggctcaggatgaacgctggcggcgtgcttaacacatgcaagtcgagcgagaaagttgtaacggatccttcgggtgaagttataactggacagcggcggacgggtgagtaacgcgtgggaaacctgccttatacaaggggatagcctcgggaaaccgggattaataccctataaaactctagtagcgcatgttacatgagtcaaagctccggcggtataagatggtcccgcgtcccattagctagttggtgaggtaacggctcaccaaggcgacgatgggtagccggcctgagagggtgaacggccacactggaactgagacacggtccagactcctacgggaggcagcagtggggaatattgcacaatgggggaaaccctgatgcagcgacgccgcgtgagcgaagaaggtcttcggatcgtaaagctctgtcctaaaggaagataatgacggtactttaggaggaagccccggctaactacgtgccagcagccgcggtaatacgtagggggcgagcgttatccggaattattgggcgtaaagggtgcgtaggcggccatgtaagtcaggcgttaaaggcatcggcttaaccgatgtaagcgtttgaaactgtgtggcttgagtacaggagaggaaagcggaattcctagtgtagcggtgaaatgcgtagatattaggaggaacaccagtggcgaaggcggctttctggactgtaactgacgctgaggcacgaaagcgtgggtagcgaacaggattagataccctggtagtccacgccgtaaacgatgagtgctaggtgttgggggtcgaacctcagtgccgaagttaacacattaagcactcc

SEQ ID NO: 4134 - DNA, 1568 bp, Gracilibacillus halophilus
  ref <308>: DATABASE ACCESSION NUMBER: NCBI ACCESSION: NZ_APML01000073.1
  ref <309>: DATABASE ENTRY DATE: 2019-04-01
  ref <313>: RELEVANT RESIDUES IN SEQ ID NO: (1)..(1568)
tttatggagagtttgatcttggctcaggacgaacgctggcggcgtgcctaatacatgcaagtcgagcgcgggaagcttgtctgatcccttcggggtgaagcgagtggaacgagcggcggacgggtgagtaacacgtgggcaacctacctgtaagattgggataactcgtggaaacgcgagctaataccgaataaagctttcggtcgcatgaccgaaagatgaaaggtggcatgagctatcacttacagatgggcccgcggcgcattagctagttggtgggataacagctcaccaaggcgacgatgcgtagccgacctgagagggtgatcggccacactgggactgagacacggcccagactcctacgggaggcagcagtagggaatcatccgcaatggacgaaagtctgacggtgcaacgccgcgtgaacgaagaaggttttcggatcgtaaagttctgttgttagggaagaacaagtgccgttcaaacagggcggtaccttgacggtacctatcgaggaagccccggctaactacgtgccagcagccgcggtaatacgtagggggcaagcgttgtccggaattattgggcgtaaagggcgcgcaggcggttccttaagtctgatgtgaaatctcgtggctcaaccatgagcggtcattggaaactggggaacttgagtacagaagaggagagcggaattccacgtgtagcggtgaaatgcgtagatatgtggaggaacaccagtggcgaaggcggctctctggtctgtgactgacgctgaggcgcgaaagcgtggggagcgaacaggattagataccctggtagtccacgccgtaaacgttgagtgctaggtgttagggggtatccgccccttagtgctgcagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcttcggacggccctagagatagggcgttcccttcggggaccgaatgacaggtggtgcatggttgtcgtcagctcgtgtcgtgagatgttgggttaagtcccgcaacgagcgcaacccttaatcttagttgccagcattaagttgggcactctaaggtgactgccggtgacaaaccggaggaaggtggggatgacgtcaaatcatcatgccccttatgacctgggctacacacgtgctacaatggatggtacaaagggcagctaagcggtgacgccaagcaaatcccagaaaaccattctcagtccggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtagggtaaccttttggagccagccgccgaaggtggggccaatgattggggtgaagtcgtaacaaggtagccgtatcggaaggtgcggctggatcacctcctttctaa

SEQ ID NO: 4135 - DNA, 1082 bp, Gracilibacillus kekensis
  ref <308>: DATABASE ACCESSION NUMBER: NCBI ACCESSION: NZ_FRCZ01000013.1
  ref <309>: DATABASE ENTRY DATE: 2019-04-01
  ref <313>: RELEVANT RESIDUES IN SEQ ID NO: (1)..(1082)
aatagggcggcaccttgacggtacctatcgaggaagccccggctaactacgtgccagcagccgcggtaatacgtagggggcaagcgttgtccggaattattgggcgtaaagcgcgcgtaggcggtttcttaagtctgatgtgaaatcttgcggctcaaccgcaagcggtcattggaaactggggaacttgagtgcagaagaggagagtggaattccacgtgtagcggtgaaatgcgtagatatgtggaggaacaccagtggcgaaggcgactctctggtctgtaactgacgctgaggtgcgaaagcgtggggagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcttcggatgtccctagagatagggagttcccttcggggaccgaatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacagagggaagcaaaaccgcgaggtcaagccaatcccataaaaccattctcagttcggattgtaggctgcaactcgcctacatgaagccggaatcgctagtaatcgtggatcagcatgccacggtgaatacgttcccgggccttgtacacaccgcccgtcacaccacgagagttggcaacacccgaagtcggtggggtaaccatttggaaccagccgccgaaggtggggccaatgattggggtgaagtcgtaacaaggtagccgtatcggaaggtgcggctggatcacctcctttctaa

SEQ ID NO: 4136 - DNA, 201 bp, Gracilibacillus lacisalsi
  ref <308>: DATABASE ACCESSION NUMBER: NCBI ACCESSION: NZ_KB898666.1
  ref <309>: DATABASE ENTRY DATE: 2019-04-01
  ref <313>: RELEVANT RESIDUES IN SEQ ID NO: (1)..(201)
tttattgagagtttgatcttggctcaggacgaacgctggcggcgtgcctaatacatgcaagtcgagcgcgggaagcttgtctgatcccttcggggtgacgtgagtggaacgagcggcggacgggtgagtaacacgtgggcaacctgcctgtaagactgggataactccgggaaaccggggctaataccggataatacattg

SEQ ID NO: 4137 - DNA, 1333 bp, Gracilibacillus massiliensis
  ref <308>: DATABASE ACCESSION NUMBER: NCBI ACCESSION: NZ_CZRP01000010.1
  ref <309>: DATABASE ENTRY DATE: 2019-04-01
  ref <313>: RELEVANT RESIDUES IN SEQ ID NO: (1)..(1333)
gctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaacaagtgccgttcgaatagggcggcaccttgacggtacctatcgaggaagccccggctaactacgtgccagcagccgcggtaatacgtagggggcaagcgttgtccggaattattgggcgtaaagcgcgcgtaggcggtttcttaagtctgatgtgaaatcttgcggctcaaccgcaagcggtcattggaaactggggaacttgagtgcagaagaggagagtggaattccacgtgtagcggtgaaatgcgtagatatgtggaggaacaccagtggcgaaggcgactctctggtctgtaactgacgctgaggtgcgaaagcgtggggagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcttcggatgtccctagagatagggagttcccttcggggaccgaatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacagagggaagcaaaaccgcgaggtcaagccaatcccataaaaccattctcagttcggattgtaggctgcaactcgcctacatgaagccggaatcgctagtaatcgtggatcagcatgccacggtgaatacgttcccgggccttgtacacaccgcccgtcacaccacgagagttggcaacacccgaagtcggtggggtaacctttggagccagccgccgaaggtggggccaatgattggggtgaagtcgtaacaaggtagccgtatcggaaggtgcggctggatcacctcctttctaa

SEQ ID NO: 4138 - DNA, 1567 bp, Gracilibacillus timonensis
  ref <308>: DATABASE ACCESSION NUMBER: NCBI ACCESSION: NZ_FLKH01000006.1
  ref <309>: DATABASE ENTRY DATE: 2019-04-01
  ref <313>: RELEVANT RESIDUES IN SEQ ID NO: (1)..(1567)
tattgagagtttgatcttggctcaggacgaacgctggcggcgtgcctaatacatgcaagtcgagcgcgggaaggcagcggaactcttcggagggaaggtgctggaacgagcggcggacgggtgagtaacacgtgggcaacctgcctgtaagacggggataactccgggaaaccggagctaatacccgatacccccttattttcacctgaagagaagggaaaagatggcctccggctatcacttacagatgggcccgcggcgcattagctagttggtaaggtaatggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggttttcggatcgtaaagttctgttgttagggaagaacaagtaccgttcgaatagggcggtaccttgacggtacctatcgaggaagccccggctaactacgtgccagcagccgcggtaatacgtagggggcaagcgttgtccggaattattgggcgtaaagcgcgcgcaggcggttctttaagtctgatgtgaaatcttgtggctcaaccacaagcggtcattggaaactggggaacttgagtacagaagaggagagcggaattccacgtgtagcggtgaaatgcgtagagatgtggaggaacaccagtggcgaaggcggctctctggtctgtaactgacgctgaggtgcgaaagcgtggggagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatctttggatgtctctagagatagggagttcccttcggggaccaaatgacaggtggtgcatggttgtcgtcagctcgtgtcgtgagatgttgggttaagtcccgcaacgagcgcaacccttaatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcaaggtgaagccaatcccataaaaccattctcagttcggattgcaggctgcaactcgcctgcatgaagccggaatcgctagtaatcgtggatcagcatgccacggtgaatacgttcccgggccttgtacacaccgcccgtcacaccacgagagttggcaacacccgaagtcggtggggtaaccaattggagccagccgccgaaggtggggccaatgattggggtgaagtcgtaacaaggtagccgtatcggaaggtgcggctggatcacctcctttctaa

SEQ ID NO: 4139 - DNA, 1554 bp, Granulicatella adiacens
  ref <308>: DATABASE ACCESSION NUMBER: NCBI ACCESSION: NZ_GG694020.1
  ref <309>: DATABASE ENTRY DATE: 2019-04-01
  ref <313>: RELEVANT RESIDUES IN SEQ ID NO: (1)..(1554)
catgagagtttgatcctggctcaggacgaacgctggcggcgtgcctaatacatgcaagtcgaacgagagcgaccggtgcttgcactggtcaatctagtggcgaacgggtgagtaacacgtgggtaacctgcccatcagagggggataacatccggaaacggatgctaaaaccgcataggtcttcgaaccgcatggtttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattcggttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccatttggagccagccgcctaaggtgggatagatgattggggtgaagtcgtaacaaggtagccgtatcggaaggtgcggctggatcacctcctttctaagga

SEQ ID NO: 4140 - DNA, 1566 bp, Granulicatella balaenopterae
  ref <308>: DATABASE ACCESSION NUMBER: NCBI ACCESSION: NZ_FOGF01000064.1
  ref <309>: DATABASE ENTRY DATE: 2019-04-01
  ref <313>: RELEVANT RESIDUES IN SEQ ID NO: (1)..(1566)
attttcatgagagtttgatcctggctcaggacgaacgctggcggcgtgcctaatacatgcaagtcgagcgaagaaacaacaggtgcttgcaccagttgtttacttagcggcgaacgggtgagtaacacgtgggtaacctacccaacagagggggataacattcggaaacggatgctaataccgcataggttcttgaatcgcatgattcgagaaggaaagaaggcgtaagctttcactgttggatggacccgcggtgcattagctagttggtaaggtaacggcttaccaaggcagtgatgcatagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgttagagaagaacaagcataatagtaactgattatgccctgacggtatctaaccagaaagccacggctaactacgtgccagcagccgcggtaatacgtaggtggcaagcgttgtccggatttattgggcgtaaagcgagcgcaggcggttccttaagtctgatgtgaaagcccacggctcaaccgtggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccttattactagttgccatcattcagttgggcactctagtgagactgccggtgacaaaccggaggaaggtggggacgacgtcaaatcatcatgccccttatgacttgggctacacacgtgctacaatggatggcacaacgagcagcgaactcgcgagggtaagcaaatctcttaaagccattctcagttcggattgtaggctgcaactcgcctacatgaagccggaatcgctagtaatcgcggatcagcatgccgcggtgaatacgttcccgggtcttgtacacaccgcccgtcacaccacgaaagtttgtaacacccaaagtcggtggggtaacctttatggagccagccgcctaaggtgggatagataattggggtgaagtcgtaacaaggtagccgtatcggaaggtgcggctggatcacctcctttctaaggaa

SEQ ID NO: 4141 - DNA, 1560 bp, Granulicatella elegans
  ref <308>: DATABASE ACCESSION NUMBER: NCBI ACCESSION: NZ_KI391971.1
  ref <309>: DATABASE ENTRY DATE: 2019-04-01
  ref <313>: RELEVANT RESIDUES IN SEQ ID NO: (1)..(1560)
tattttcatgagagtttgatcctggctcaggacgaacgctggcggcgtgcctaatacatgcaagtcgaacgagagcgaccggtgcttgcactggtcaatctagtggcgaacgggtgagtaacacgtgggtaacctgcccatcagagggggataacattcggaaacggatgctaaaaccgcataggttctacagtcgcatgactgaagaaggaaaagaggcttcggcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggatttcggttcgtaaaactctgttgttagagaagaacagcgcatagagtaactgttatgcgtgtgacggtatctaaccagaaagccacggctaactacgtgccagcagccgcggtaatacgtaggtggcaagcgttgtccggatttattgggcgtaaagcgagcgcaggcggtcaattaagtctgatgtgaaagcccccggctcaaccggggagggtcattggaaactggttgacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccttatggagccagccgcctaaggtgggatagatgattggggtgaagtcgtaacaaggtagccgtatcggaaggtgcggctggatcacctcctttctaagga

SEQ ID NO: 4142 - DNA, 1557 bp, Granulicatella sp. 572.rep1 STHE
  ref <308>: DATABASE ACCESSION NUMBER: NCBI ACCESSION: NZ_JVBO01000005.1
  ref <309>: DATABASE ENTRY DATE: 2019-04-01
  ref <313>: RELEVANT RESIDUES IN SEQ ID NO: (1)..(1557)
tttcatgagagtttgatcctggctcaggacgaacgctggcggcgtgcctaatacatgcaagtcgaacgagagcgaccggtgcttgcactggtcaatctagtggcgaacgggtgagtaacacgtgggtaacctgcccatcagagggggataacatccggaaacggatgctaaaaccgcataggtcttcgagccgcatggcttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccatttggagccagccgcctaaggtgggatagatgattggggtgaagtcgtaacaaggtagccgtatcggaaggtgcggctggatcacctcctttctaagga

SEQ ID NO: 4143 - DNA, 1557 bp, Granulicatella sp. 572.rep2 STHE; identical to SEQ ID NO: 4142
  ref <308>: DATABASE ACCESSION NUMBER: NCBI ACCESSION: NZ_JVBN01000001.1
  ref <309>: DATABASE ENTRY DATE: 2019-04-01
  ref <313>: RELEVANT RESIDUES IN SEQ ID NO: (1)..(1557)

SEQ ID NO: 4144 - DNA, 1557 bp, Granulicatella sp. HMSC30F09
  ref <308>: DATABASE ACCESSION NUMBER: NCBI ACCESSION: NZ_KV786421.1
  ref <309>: DATABASE ENTRY DATE: 2019-04-01
  ref <313>: RELEVANT RESIDUES IN SEQ ID NO: (1)..(1557)
tttcatgagagtttgatcctggctcaggacgaacgctggcggcgtgcctaatacatgcaagtcgaacgagagcgaccggtgcttgcactggtcaatctagtggcgaacgggtgagtaacacgtgggtaacctgcccatcagagggggataacatccggaaacggatgctaaaaccgcataggtcttcgaaccgcatggtttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccatttggagccagccgcctaaggtgggatagatgattggggtgaagtcgtaacaaggtagccgtatcggaaggtgcggctggatcacctcctttctaagga

SEQ ID NO: 4145 - DNA, 1557 bp, Granulicatella sp. HMSC31F03
  ref <308>: DATABASE ACCESSION NUMBER: NCBI ACCESSION: NZ_KV790858.1
  ref <309>: DATABASE ENTRY DATE: 2019-04-01
  ref <313>: RELEVANT RESIDUES IN SEQ ID NO: (1)..(1557)
tttcatgagagtttgatcctggctcaggacgaacgctggcggcgtgcctaatacatgcaagtcgaacgagagcgaccggtgcttgcactggtcaatctagtggcgaacgggtgagtaacacgtgggtaacctgcccatcagagggggataacatccggaaacggatgctaaaaccgcataggtcttcgaaccgcatggtttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccatttggagccagccgcctaaggtgggatagatgattggggtgaagtcgtaacaaggtagccgtatcggaaggtgcggctggatcacctcctttctaagga

SEQ ID NO: 4146 - DNA, 1504 bp, Granulicella mallensis
  ref <308>: DATABASE ACCESSION NUMBER: NCBI ACCESSION: NC_016631.1
  ref <309>: DATABASE ENTRY DATE: 2019-04-01
  ref <313>: RELEVANT RESIDUES IN SEQ ID NO: (1)..(1504)
taaacgagagtttgatcctggctcagaatcaacgctggcggcgtgcctaacacatgcaagtcgcacgagaaagggacttcggtcctgagtacagtggcgcacgggtgagtaacacgtgacttatctacctccgagtggggaataacctagagaaatctgggctaataccgcataacacttacgagtcaaagcagcaatgcgcttggagaggaggtcgcggcagattagttagttggcggggtaatggcccaccaagacgatgatctgtatccggcctgagagggcgcacggacacactggaactgaaacacggtccagactcctacgggaggcagcagtggggaattttgcgcaatgggggaaaccctgacgcagcaacgccgcgtggaggatgaaatcccttgggatgtaaactcctttcgatcgggaagataatgacggtaccgagagaagaagccccggctaacttcgtgccagcagccgcggtaatacgaggggggcaagcgttgttcggaattattgggcgtaaagggtgcgtaggcggtttgataagtcacatgtgaaatcttcgggctcaacccgaagtctgcatgcgaaactgtcgggcttgagtatgggagaggtgagtggaatttccggtgtagcggtgaaatgcgtagatatcggaaggaacacctgtggcgaaagcggctcactggaccataactgacgctgatgcacgaaagctaggggagcaaacaggattagataccctggtagtcctagccctaaacgatgattgcttgatgtggtgggtacccaatcctaccgtgtcgaagctaacgcgataagcaatccgcctggggagtacggtcgcaaggctgaaactcaaaggaattgacgggggcccgcacaagcggtggagcatgtggtttaattcgacgcaacgcgaagaaccttacctgggctcgaaatgtacaggacaacggtagaaatatcgtctcccagcaatgggtctgtatataggtgctgcatggctgtcgtcagctcgtgtcgtgagatgttgggttaagtcccgcaacgagcgcaacccttatctccagttgctaccatttagttgagcactctggcgaaaccgcctcggataacggggaggaaggtggggatgacgtcaagtcctcatggcctttatgtccagggctacacacgtgctacaatggccggtacaaaccgctgcaaccccgcgagggtgagctaatcggaaaaagccggcctcagttcggattggagtctgcaactcgactccatgaagctggaatcgctagtaatcgtggatcagcatgccacggtgaatacgttcccgggccttgtacacaccgcccgtcacatcacgaaagtgggttgcactagaagtcggtgcgctaaccgcaagggagcagccgcccaaggtgtaattcatgattggggtgaagtcgtaacaaggtagccgtaggagaacctgcggctggatcacctcctttctaag

SEQ ID NO: 4147 - DNA, 1497 bp, Granulicella sp. AF10
  ref <308>: DATABASE ACCESSION NUMBER: NCBI ACCESSION: NZ_RDSM01000003.1
  ref <309>: DATABASE ENTRY DATE: 2019-04-01
  ref <313>: RELEVANT RESIDUES IN SEQ ID NO: (1)..(1497)
gagagtttgatcctggctcagaatcaacgctggcggcgtgcctaacacatgcaagtcgcacgagaaaggggcttcggtcctgagtaaagtggcgcacgggtgagtaacacgtgaatcatctaccctcgagtggggaataacctagagaaatctgggctaataccgcataacacttacgagtcaaagcagcaatgcgcttggggaggagttcgcggccgattagctagttggcggggtaatggcccaccaaggcgatgatcggtatccggcctgagagggcgcacggacacactggaactgaaacacggtccagactcctacgggaggcagcagtggggaattttgcgcaatgggggaaaccctgacgcagcaacgccgcgtggaggatgaagtatcttggtacgtaaactcctttcgatggggaagataatgacggtacccatagaagaagccccggctaacttcgtgccagcagccgcggtaatacgaggggggcaagcgttgttcggaattattgggcgtaaagggtgcgtaggcggtttgacaagtcttatgtgaaatcttcgggctcaacccgaagtctgcatgagaaactgttgagcttgagtatgggagaggtgagtggaatttccggtgtagcggtgaaatgcgtagatatcggaaggaacacctgtggcgaaagcggctcactggaccataactgacgctgaggcacgaaagctaggggagcaaacaggattagataccctggtagtcctagccctaaacgatgattgcttgatgtggccggtacccaatccggccgtgtcgaagctaacgcgataagcaatccgcctggggagtacggtcgcaaggctgaaactcaaaggaattgacgggggcccgcacaagcggtggagcatgtggtttaattcgacgcaacgcgaagaaccttacctgggctcgaaatgtacatgaatccggcagaaacgtcggcgtctcgcaagagacatgtatataggtgctgcatggctgtcgtcagctcgtgtcgtgagatgttgggttaagtcccgcaacgagcgcaacccttatcttcagttgctaccatttagttgagcactctgacgaaaccgcctcggataacggggaggaaggtggggatgacgtcaagtcctcatggcctttatgtccagggctacacacgtgctacaatggccggtacaaaccgctgcaaccccgcgagggtgagctaatcggaaaaagccggcctcagttcggattggagtctgcaactcgactccatgaagctggaatcgctagtaatcgtggatcagcatgccacggtgaatacgttcccgggccttgtacacaccgcccgtcacatcacgaaagtgggttgcactagaagtcggtgcgctaaccgcaagggagcagccgcccaaggtgtaattcatgattggggtgaagtcgtaacaaggtagccgtaggagaacctgcggctggatcacctcctttcta

SEQ ID NO: 4148 - DNA, 1498 bp, Granulicella sp. GAS466
  ref <308>: DATABASE ACCESSION NUMBER: NCBI ACCESSION: NZ_RJKT01000001.1
  ref <309>: DATABASE ENTRY DATE: 2019-04-01
  ref <313>: RELEVANT RESIDUES IN SEQ ID NO: (1)..(1498)
gagagtttgatcctggctcagaatcaacgctggcggcgtgcctaacacatgcaagtcgcacgagaaaggggcttcggccctgagtaaagtggcgcacgggtgagtaacacgtgaatcatctaccctcgagtggggaataacctagagaaatctgggctaataccgcataacacttacgagtcaaagcagcaatgcgcttggggaggagttcgcggccgattagttagttggcggggtaatggcccaccaagacgatgatcggtatccggcctgagagggcgcacggacacactggaactgaaacacggtccagactcctacgggaggcagcagtggggaattttgcgcaatgggggaaaccctgacgcagcaacgccgcgtggaggatgaaatcccttgggatgtaaactcctttcgattgggaagattatgacggtaccaatagaagaagccccggctaacttcgtgccagcagccgcggtaatacgaggggggcaagcgttgttcggaattattgggcgtaaagggtgcgtaggcggtttgacaagtcttatgtgaaatctatgggctcaacccatagtctgcatgagaaactgttgagcttgagtatgggagaggtgagtggaatttccggtgtagcggtgaaatgcgtagatatcggaaggaacacctgtggcgaaagcggctcactggaccataactgacgctgaggcacgaaagctaggggagcaaacaggattagataccctggtagtcctagccctaaacgatgattgcttggtgtggcaggtacccaatcctgccgtgccgaagctaacgcgataagcaatccgcctggggagtacggtcgcaaggctgaaactcaaaggaattgacgggggcccgcacaagcggtggagcatgtggtttaattcgacgcaacgcgaagaaccttacctgggctcgaaatgtagtggaatccggcagaaacgtcggcgtctagcaatagaccgctatataggtgctgcatggctgtcgtcagctcgtgtcgtgagatgttgggttaagtcccgcaacgagcgcaacccttatcttcagttgctaccatttagttgagcactctgacgaaaccgcctcggataacggggaggaaggtggggatgacgtcaagtcctcatggcctttatgtccagggctacacacgtgctacaatggccggtacaaaccgctgcaaacccgcgagggggagctaatcggaaaaagccggcctcagttcggattggagtctgcaactcgactccatgaagctggaatcgctagtaatcgtggatcagcatgccacggtgaatacgttcccgggccttgtacacaccgcccgtcacatcacgaaagtgggttgcactagaagtcggtgcgctaaccgcaagggagcagccgcccaaggtgtaattcatgattggggtgaagtcgtaacaaggtagccgtaggagaacctgcggctggatcacctcctttctaa

SEQ ID NO: 4149 - DNA, 1550 bp, Grimontella sp. AG753
  ref <308>: DATABASE ACCESSION NUMBER: NCBI ACCESSION: NZ_QJJI01000057.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagcttgttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggagccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4150 - DNA, 1554 bp, Grimontia hollisae
  ref <308>: DATABASE ACCESSION NUMBER: NCBI ACCESSION: NZ_UGHD01000002.1
  ref <309>: DATABASE ENTRY DATE: 2019-04-01
  ref <313>: RELEVANT RESIDUES IN SEQ ID NO: (1)..(1554)
taattgaagagtttgatcatggctcagattgaacgctggcggcaggcctaacacatgcaagtcgagcggcagcgacatgaacaatccttcgggtgcgttcatgggcggcgagcggcggacgggtgagtaatggctgggaacctgccctgacgagggggataaccactggaaacggtggctaataccgcataatgtctttggaccaaagagggggactttcgggcctctcgcgtcaggatgggcccagttgggattagctggttggtgaggtaaaggctcaccaaggcgacgatccctagctggtttgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagccgtgaggaaggtagcgtagttaatacctgcgttacttgacgttagcggcagaagaagcaccggctaactccgtgccagcagccgcggtaatacggagggtgcgagcgttaatcggaattactgggcgtaaagcgcatgcaggcggtctgttaagcaagatgtgaaagccccgggcttaacctgggagtggcattttgaactggcaggctagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgctgtaaacgatgtctacttggaggctgtggtctagaaccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatcctcagaagccggaagagattctggtgtgccttcgggaactgagagacaggtgctgcatggctgtcgtcagctcgtgttgtgaaatgttgggttaagtcccgcaacgagcgcaacccttatccttgtttgccagcacttcgggtgggaactccagggagactgccggtgataaaccggaggaaggtggggacgacgtcaagtcatcatggcccttacgagtagggctacacacgtgctacaatggtgcatacagagggcagcgagaccgcgaggtggagcgaatcccagaaagtgcatcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttacc

SEQ ID NO: 4151 - DNA, 1529 bp, Gryllotalpicola sp. 2DFW10M-5
  ref <308>: DATABASE ACCESSION NUMBER: NCBI ACCESSION: NZ_CP032624.1
  ref <309>: DATABASE ENTRY DATE: 2019-04-01
  ref <313>: RELEVANT RESIDUES IN SEQ ID NO: (1)..(1529)
tggagagtttgatcctggctcaggacgaacgctggcggcgtgcttaacacatgcaagtcgaacgatgaaggctggtgcttgcactggctggattagtggcgaacgggtgagtaacacgtgagtaacctgcccttggctctgggatacgcgttggaaacggcgtctaatactggataggacttctcgccgcatggtggggggtggaaagatttatcggccatggatgggctcgcggcctatcagcttgttggtgaggtagtggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgggggatgacggccttcgggttgtaaacctcttttggcagggaagaagccttcgggtgacggtacctgcagaaaaaggaccggctaactacgtgccagcagccgcggtaatacgtagggtccgagcgttgtccggaattattgggcgtaaagagctcgtaggcggttcgtcgcgtctgccgtgaaatcctcaggctcaacctgaggcgtgcggtgggtacgggcgggctagagtgcggtaggggagaatggaactcctggtgtagcggtggaatgcgcagatatcaggaagaacaccgatggcgaaggcagttctctgggccgtaactgacgctgaggagcgaaagcgtggggagcgaacaggattagataccctggtagtccacgccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatataccggaaacggccagagatggtcgcccccttgtggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccggtacaaagggctgcgatgtcgtaaggcggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgtaaggagggagctgtcgaaggtgggatcggtgattaggactaagtcgtaacaaggtagccgtaccggaaggtgcggctggatcacctcctttctaagga

SEQ ID NO: 4152 - DNA, 1530 bp, Gulosibacter sp. Marseille-P7157
  ref <308>: DATABASE ACCESSION NUMBER: NCBI ACCESSION: NZ_UYZX01000002.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaaggccagcttgctgggtggattagtggcgaacgggtgagtaacacgtgagcaacgtgcccgaaactctggaataaccaccggaaacggtggctaatactggatatgtgccagggaggcatctcctctggttggaaagatttttcggtttcggatcggctcacggcctatcagcttgttggcggggtaaaggcccaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcctgcagtgggtacgggcagacttgagtgcggtaggggagattggaattcctggtgtagcggtggaatgcgcagatatcaggaggaacaccgatggcgaaggcagatctctgggccgttactgacgctgaggagcgaaagcatggggagcgaacaggattagataccctggtagtccatgccgtaaacgttgggcgctagatgtggggaccattccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatataccggaaacttccagagatggttgccctgcttgcagtcggtatacaggtggtgcatggttgtcgtcagctcgtgtcgtgagatgttcggttaagtccggcaacgagcgcaaccctcgtcctatgttgccagcacgttatggtgggaactcatgggatactgccgtggtcaacacggaggaaggtggggatgacgtcaaatcatcatgccccttatgtcttgggcttcacgcatgctacaatggccggtacaatgggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagctgtcgaaggtgggatcggtgattaggactaagtcgtaacaaggtagccgtaccggaaggtgcggctggatcacctcctttctaagga

SEQ ID NO: 4153 - DNA, 1546 bp, Guyparkeria sp. SCN-R1
  ref <308>: DATABASE ACCESSION NUMBER: NCBI ACCESSION: NZ_QZMT01000036.1
  ref <309>: DATABASE ENTRY DATE: 2019-04-01
  ref <313>: RELEVANT RESIDUES IN SEQ ID NO: (1)..(1546)
aaagtgaagagtttgatcctggctcagattgaacgctggcggcatgcttaacacatgcaagtcgaacggtaacaggagagagcttgctctcttgctgacgagtggcggacgggtgagtaatacatgggaatctgccctgaggtgggggataacccggggaaactcgggctaataccgcatgatctcttcggagcaaagtgggggaccttcgggcctcacgccttgggatgagcccatgtctgattagctagttggtagggtaaaggcctaccaaggcgacgatcagtagccggcctgagagggtgtacggccacactgggactgagacacggcccagactcctacgggaggcagcagtggggaatattggacaatgggggcaaccctgatccagcaatgccgcgtgtgtgaagaaggcctgcgggttgtaaagcacttttatcggggaagaataggttgtcgttaatagcgccaacacttgacattacccgttgaataagcaccggctaactccgtgccagcagccgcggtaatacggagggtgcgagcgttaatcggaattactgggcgtaaagcgtgcgtaggcggaagcttaagtctgatgtgaaagccccgggcttaacctgggaatggcattggaaactgggtttctagagtgtggtagaggatagtggaatttccagtgtagcggtgaaatgcgtagatattggaaagaacaccgatggcgaaggcagctatctgggccaacactgacgctgaggtacgaaagcgtggggagcaaacaggattagataccctggtagtccacgccctaaacgatgtcgacttgtcgttgggggagtttaatccttcagtgacggagctaacgcgttaagtcgaccgcctggggagtacggccgcaaggttgaaactcaaaggaattgacgggggcccgcacaagcggtggagcatgtggtttaattcgatgcaacgcgaagaaccttacctggccttgacatcctcggaacttggcagagatgccttggtgccttcgggaaccgagtgacaggtgctgcatggctgtcgtcagctcgtgtcgtgagatgttgggttaagtcccgcaacgagcgcaacccttattcctagttgccagcacttcgggtgggaactctagggagactgccggtgacaaaccggaggaaggtggggatgacgtcaagtcatcatggcccttatggccagggctacacacgtgctacaatggtcggtccaatgggtagctaagccgcgaggtggagccaatccctcaaagccgatcttagtccggattgcagtctgcaactcgactgcatgaagtcggaatcgctagtaatcgcagatcagcattgctgcggtgaatacgttcccgggccttgtacacaccgcccgtcacaccatgggagtgggttgcaccagaagtggctagtctaaccttcgggaggacggtcaccacggtgtgattcatgactggggtgaagtcgtaacaaggtagccgtaggggaacctgcggctggatcacctccttaaa

SEQ ID NO: 4154 - DNA, 1489 bp, Haematospirillum jordaniae
  ref <308>: DATABASE ACCESSION NUMBER: NCBI ACCESSION: NZ_CP014525.1
  ref <309>: DATABASE ENTRY DATE: 2019-04-01
  ref <313>: RELEVANT RESIDUES IN SEQ ID NO: (1)..(1489)
acttgagagtttgatcctggctcagaacgaacgctggcggcaggcctaacacatgcaagtcgagcgcccggatttatccgggagcggcgcacgggtgagtaacgcgtgggaacatgccctgaagtacggaacaacctggggaaaccttggctaataccgtatacgccctgagggggaaagatttatcgctttgggattggcccgcgttggattagctagttggtgtggtaacggcgcaccaaggcgacgatccataactggtctgagaggatgaccagtcacactgggactgagacacggcccagactcctacgggaggcagcagtggggaatattggacaatgggcgaaagcctgatccagccatgccgcgtgagtgaagaaggccttcgggttgtaaagctctttcagcggggacgatgatgacggtacccgcagaagaagccccggctaacttcgtgccagcagccgcggtaatacgaagggggctagcgttgttcggaattactgggcgtaaagcgcgcgtaggcggctttgtcagtcaggggtgaaatcccggggctcaaccccggaactgcctttgatactgcaaggcttgagtccgtgagaggatggtggaatacccagtgtagaggtgaaattcgtagatattgggtggaacaccggtggcgaaggcgaccatctggcacggtactgacgctgaggtgcgaaagcgtggggagcaaacaggattagataccctggtagtccacgctgtaaacgatgagtgccagctgtcggaatgcatgcatttcggtggcgcagctaacgcattaagcactccgcctggggagtacggccgcaaggttaaaactcaaaggaattgacgggggcccgcacaagcggtggagcatgtggtttaattcgaagcaacgcgcagaaccttaccagcccttgacatggggatcgcggaaccggagacggttccttcagttcggctggatcccacacaggtgctgcatggctgtcgtcagctcgtgtcgtgagatgttgggttaagtcccgcaacgagcgcaaccctcgtcctcagttgccatcattaagttgggcactctggggaaactgccggtgacaagccggaggaaggtggggatgacgtcaagtcctcatggcccttacgggctgggctacacatgtgctacaatggcgactacagagggaagccacttcgcgagaaggcgcaaatcccaaaaagtcgtcccagttcggattgcactctgcaactcgagtgcatgaagtcggaatcgctagtaatcgtggatcagcacgccacggtgaatacgttcccgggccttgtacacaccgcccgtcacaccatgggagttggttttacccgaagacggttcgctaaccgcaaggaggcagccggccacggtagggtcagcgactggggtgaagtcgtaacaaggtagccgtaggggaacctgcggctggatcacctcctttcaagg

SEQ ID NO: 4155 - DNA, 1544 bp, Haemophilus parainfluenzae
  ref <308>: DATABASE ACCESSION NUMBER: NCBI ACCESSION: NZ_LR134481.1
  ref <309>: DATABASE ENTRY DATE: 2019-04-01
  ref <313>: RELEVANT RESIDUES IN SEQ ID NO: (1)..(1544)
ttgaattgaagagtttgatcatggctcagattgaacgctggcggcaggcttaacacatgcaagtcgaacggtaacataaagaagcttgcttctttgatgacgagtggcggacgggtgagtaatgcttgggaatctggcttatggagggggataactacgggaaactgtagctaataccgcgtaatatcgaaagattaaagtgtgggaccttcgggccacatgccataagatgagcccaagtgggattaggtagttggtgaggtaaaggctcaccaagccgacgatctctagctggtctgagaggatgaccagccacactgggactgagacacggcccagactcctacgggaggcagcagtggggaatattgcgcaatgggggcaaccctgacgcagccatgccgcgtgaatgaagaaggccttcgggttgtaaagttctttcggtagtgaggaaggtggttagtttaataggctagccaattgacgttaactacagaagaagcaccggctaactccgtgccagcagccgcggtaatacggagggtgcgagcgttaatcggaataactgggcgtaaagggcacgcaggcggacttttaagtgaggtgtgaaagccccgggcttaacctgggaattgcatttcagactgggagtctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgatgtcgatttgggggttgaactttgagtttggcgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaacattccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacagagggaagcgagagtgcgagctggagcgaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttacc

SEQ ID NO: 4156 - DNA, 1552 bp, Hafnia alvei
  ref <308>: DATABASE ACCESSION NUMBER: NCBI ACCESSION: NZ_UGHM01000004.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggtagcacaagagagcttgctctctgggtgacgagcggcggacgggtgagtaatgtctgggaaactgcctgatggagggggataactactggaaacggtagctaataccgcatgacgtcttcggaccaaagtgggggaccttcgggcctcacgccatcagatgtgcccagatgggattagctagtaggtggggtaatggctcacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggttgattaagtcagatgtgaaatccccgagcttaacttgggaactgcatttgaaactggtcagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 4157 - DNA, 903 bp, Hafnia paralvei
  ref <308>: DATABASE ACCESSION NUMBER: NCBI ACCESSION: NZ_QPIU01000021.1
  ref <309>: DATABASE ENTRY DATE: 2019-04-01
  ref <313>: RELEVANT RESIDUES IN SEQ ID NO: (1)..(903)
agctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcgagtaatgtcgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 4158 - DNA, 1553 bp, Hafnia sp. CBA7124
  ref <308>: DATABASE ACCESSION NUMBER: NCBI ACCESSION: NZ_AP017469.1
  ref <309>: DATABASE ENTRY DATE: 2019-04-01
  ref <313>: RELEVANT RESIDUES IN SEQ ID NO: (1)..(1553)
tttaattgaagagtttgatcatggctcagattgaacgctggcggcaggcctaacacatgcaagtcgagcggtagcacaagagagcttgctctctgggtgacgagcggcggacgggtgagtaatgtctgggaaactgcctgatggagggggataactactggaaacggtagctaataccgcatgatgtcttcggaccaaagtgggggaccttcgggcctcacgccatcagatgtgcccagatgggattagctagtaggtggggtaatggctcacctaggcgacgatctctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccgcagtgattgacgttactcgcagaagaagcaccggctaactccgtgccagcagccgcggtaatacggagggtgcaagcgttaatcggaattactgggcgtaaagcgcacgcaggcggttgattaagtcagatgtgaaatccccgagcttaacttgggaactgcatttgaaactggtcagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 4159 - DNA, 1537 bp, Hahella sp. KA22
  ref <308>: DATABASE ACCESSION NUMBER: NCBI ACCESSION: NZ_CP035490.1
  ref <309>: DATABASE ENTRY DATE: 2019-04-01
  ref <313>: RELEVANT RESIDUES IN SEQ ID NO: (1)..(1537)
taaactgaagagtttgatcatggctcagattgaacgctggcggcaggcttaacacatgcaagtcgagcggtaacagtccttcgggagctgacgagcggcggacgggtgagtaatgcataggaatctgcctgttagagggggatagcccggggaaactcggattaataccgcatacgccctacgggggaaagcaggggatcttcggaccttgcgctaacagatgagcctatgtcggattagctagttggtagggtaagagcctaccaaggcgacgatccgtaactggtctgagaggatgatcagtcacactggaactgagacacggtccagactcctacgggaggcagcagtggggaatattggacaatgggggcaaccctgatccagccatgccgcgtgtgtgaagaaggccttcgggttgtaaagcactttcagtggggaggaaagggcagttgctaatatcagctgcagttgacgttacccacagaagaagcaccggcaaactccgtgccagcagccgcggtaatacggagggtgcgagcgttaatcggaattactgggcgtaaagcgcgcgtaggcggttgcttaagctagatgtgaaatccccgggctcaacctgggaactgcatttagaactgggcgactagagttttggagaggagggtagaattccaggtgtagcggtgaaatgcgtagagatctggaggaataccagtggcgaaggcggccctctggccaaaaactgacgctgaggtgcgaaagcgtggggagcaaacaggattagataccctggtagtccacgccgtaaacgatgagaactagccgttggggtccttagagactttagtggcgcagctaacgcgataagttctccgcctggggagtacggccgcaaggttaaaactcaaatgaattgacgggggcccgcacaagcggtggagcatgtggtttaattcgaagcaacgcgaagaaccttacctggccttgacatccagagaactttccagagatggattggtgccttcgggaactctgagacaggtgctgcatggctgtcgtcagctcgtgttgtgaaatgttgggttaagtcccgtaacgagcgcaacccttgtccctatttgccagcacttcgggtgggaactttagggagactgccggtgacaaaccggaggaaggtggggacgacgtcaagtcatcatggcccttacggccagggctacacacgtgctacaatggggcgtacagagggttgccaagccgcgaggtggagctaatctcttaaagcgtctcgtagtccggattggagtctgcaactcgactccatgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 4160 - DNA, 304 bp, Halalkalibacillus halophilus
  ref <308>: DATABASE ACCESSION NUMBER: NCBI ACCESSION: NZ_AUHI01000012.1
  ref <309>: DATABASE ENTRY DATE: 2019-04-01
  ref <313>: RELEVANT RESIDUES IN SEQ ID NO: (1)..(304)
tatggagagtttgatcctggctcaggacgaacgctggcggcgtgcctaatacatgcaagtcgagcgcaggaagcagacagatcccttcggggtgacgtctgtggaatgagcggcggacgggtgagtaacacgtgggcaacctgcctgtaagactgggataaccccgggaaaccggggctaataccggataacatcaggaacctcctggttcttgagtgaaagatggcctttgtgctatcacttacagatgggcccgcggcgcattagctagttggtaaggtaatggcttaccaaggcgacgatg

SEQ ID NO: 4161 - DNA, 1569 bp, Halalkalibacillus sp. B3227
  ref <308>: DATABASE ACCESSION NUMBER: NCBI ACCESSION: NZ_PJNH01000002.1
  ref <309>: DATABASE ENTRY DATE: 2019-04-01
  ref <313>: RELEVANT RESIDUES IN SEQ ID NO: (1)..(1569)
tttattggagagtttgatcctggctcaggacgaacgctggcggcgtgcctaatacatgcaagtcgagcgcgtgaagcaagcagatctccttcgggagtgacgcttgtggaacgagcggcggacgggtgagtaacacgtgggtaacctgcctgtaagactgggataaccccgggaaaccggggctaataccggataacatttcggatcgcatgatccgaaagtgaaagatggcttcttgctatcacttacagatggacccgcggcgcattagctagttggtaaggtagtggcttaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaggaaggtcttcggatcgtaaagctctgttgtgagggaagaacaagtgccgtgcgaatagagcggcaccttgacggtacctcaccagaaagccacggctaactacgtgccagcagccgcggtaatacgtaggtggcaagcgttgtccggaattattgggcgtaaagcgcgcgcaggcggttccttaagtctgatgtgaaatcttgcggctcaaccgcaagcggtcattggaaactggggaacttgaggacagaagaggagagtggaattccacgtgtagcggtgaaatgcgtagatatgtggaggaacaccagtggcgaaggcgactctctggtctgttactgacgctgaggcgcgaaagcgtggggagcgaacaggattagataccctggtagtccacgccgtaaacgatgagtgctaggtgttagggggtccaacccttagtgctgcagttaacgcaataagcactccgcctggggagtacggccgcaaggctgaaactcaaaggaattgacgggggcccgcacaagcggtggagcatgtggtttaattcgaagcaacgcgaagaaccttaccaggtcttgacatctttggaccaccctagagatagggttttcccttcggggaccaaatgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggaagcgagaccgcgaggttgagccaatcccataaagccattctcagttcggactgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtggagtaacctttttggagctagccgccgaaggtggggccaatgattggggtgaagtcgtaacaaggtagccgtatcggaaggtgcggctggatcacctcctttcta

SEQ ID NO: 4162 - DNA, 1556 bp, Halanaerobium congolense
  ref <308>: DATABASE ACCESSION NUMBER: NCBI ACCESSION: NZ_FRCV01000062.1
  ref <309>: DATABASE ENTRY DATE: 2019-04-01
  ref <313>: RELEVANT RESIDUES IN SEQ ID NO: (1)..(1556)
tttatacggagagtttgatcctggctcaggacgaacgctggcggcgtgcttaacacatgcaagtcgaacggtctacctcgacagaaaccttcgggttgaagacgagatctagatagtggcggacgggtgagtaacacgtgaataatctatcctcaagtctgggataacctggcgaaagtcgggctaatccgaggtaagctgagagtgtggcatcacacaatcagaaaaggtggcattgccatcgtttgaggaggagttcgcggtagattagctagctggtgaggtaacggctcaccagggcaacaatctatagctggtctgagaggacgatcagtcacactggaactgagacacggtccagactcctacgggaggcagcagtggggaatcttccacaatgggcgcaagcctgatggagcaacgccgcgtgaatgaagaaggccttagggtcgtaaagttctgtccttagggaagaaccgtgggtatagcaaatgatacccacctgacggtacctttggaggaagcactggctaactacgtgccagcagccgcggtaatacgtagagtgcaagcgttgtccggaattattgggcgtaaagggtacgcaggcggatagtaaagtcaagcgtgaaaggtgtcggcttaaccgacagactgcgtttgaaactgattatcttgagtgtaacagaggagagtggaattcctagtgtagtggtgaaatacgtagatattaggaagaacaccagtggcgaaggcgactctctgggttaacactgacgctgaggtacgaaagctgggggagcgaacgggattagataccccggtagtcccagccgtaaacgatggatactaggtgttggaggttcgaatccttcagtgccggagttaacgcattaagtatcccgcctggggattacgatcgcaagattgaaactcaaaggaattgacgggggcccgcacaagcggtggagcatgtggtttaattcgaagcaacgcgaagaaccttaccgagaattgacatcccgtgaccatctatgaaagtagaatttggcacttagtgccacacggagacaggtggtgcatggctgtcgtcagctcgtgtcgtgagatgttgggttaagtcccgcaacgagcgcaacccctgttcttagttgccagcgagtaatgtcggggactctaagaagactgccggtgaaagtcggaggaaggtggggatgacgtcaagtcctcatgccctttatatctcgggctacacacgtgctacaatggctgatacagaggggagcaaagctgcgaagtggagcaaatcctataaaatcagtcccagttcggattgcaggctgcaactcgcctgtatgaagttggaatcgctagtaatcgcaggtcagcatactgcggtgaatacgttcccgggccttgtacacaccgcccgtcacaccaatcgagttggatgcaccagaagtcatctgaggatgccaaaggtgtgtccggcaagaggggtgaagtcgtaacaaggtagccgtaccggaaggtgcggctggatcacctcctttcta

SEQ ID NO: 4163 - DNA, 1556 bp, Halanaerobium kushneri
  ref <308>: DATABASE ACCESSION NUMBER: NCBI ACCESSION: NZ_FTNC01000054.1
  ref <309>: DATABASE ENTRY DATE: 2019-04-01
  ref <313>: RELEVANT RESIDUES IN SEQ ID NO: (1)..(1556)
tttatacggagagtttgatcctggctcaggacgaacgctggcggcgtgcttaacacatgcaagtcgaacggtctacctcgacagaaaccttcgggttgacgacgagatctagatagtggcggacgggtgagtaacacgtgaataatctgtcctcaagtccgggataacctggcgaaagtcgggctaatccggggtaagctgagagtgtggcatcacacaatcagaaaaggtggctctgccatcgtttgaggaggagttcgcggtagattagctagctggtgaggtaacggctcaccagggcaacaatctatagctggtctgagaggacgatcagtcacactggaactgagacacggtccagactcctacgggaggcagcagtggggaatcttccacaatgggcgaaagcctgatggagcaacgccgcgtgagtgaagaaggtcttaggattgtaaagctctgtccttagggaagaaccgtgggtatagtaaatgctacccacctgacggtacctttggaggaagcactggctaactacgtgccagcagccgcggtaatacgtagagtgcaagcgttgtccggaattattgggcgtaaagggtacgcaggcggataatcaagtcaagcgtgaaaggtgtcggcttaaccgacagactgcgtttgaaactggttatcttgagtgtaacagaggagagtggaattcctagtgtagtggtgaaatacgtagatattaggaagaacaccagtggcgaaggcgactctctgggttaacactgacgctgaggtacgaaagctgggggagcgaacgggattagataccccggtagtcccagccgtaaacgatggatactaggtgttggaggttcgaatccttcagtgccggagttaacgcattaagtatcccgcctggggattacgatcgcaagattgaaactcaaaggaattgacgggggcccgcacaagcggtggagcatgtggtttaattcgaagcaacgcgaagaaccttaccgagaattgacatcccgtgaccatctatgagagtagaatttagcactttgtgctacacggagacaggtggtgcatggctgtcgtcagctcgtgtcgtgagatgttgggttaagtcccgcaacgagcgcaacccctgttcttagttgccagcgagtaatgtcggggactctaagaagactgccggtgaaagtcggaggaaggtggggatgacgtcaagtcctcatgccctttatatctcgggctacacacgtgctacaatggctgatacagaggggagcaaagctgcgaagtggagcaaatccttgaaaatcagtcccagttcggattgcaggctgcaactcgcctgtatgaagttggaatcgctagtaatcgcaggtcagcatactgcggtgaatacgttcccgggccttgtacacaccgcccgtcacaccaatcgagttggatgcaccagaagtcatctgcggatgccaaaggtgtgtccggtaagaggggtgaagtcgtaacaaggtagccgtaccggaaggtgcggctggatcacctcctttcta

SEQ ID NO: 4164 - DNA, 1555 bp, Halanaerobium praevalens
  ref <308>: DATABASE ACCESSION NUMBER: NCBI ACCESSION: NC_017455.1
  ref <309>: DATABASE ENTRY DATE: 2019-04-01
  ref <313>: RELEVANT RESIDUES IN SEQ ID NO: (1)..(1555)
tttttatggagagtttgatcctggctcaggacgaacgctggcggcgtgcttaacacatgcaagtcgaacggtctacctcgactgataccttcgggttgaagacgagatctagatagtggcggacgggtgagtaacacgtgaataatctgtcctcaagtctgggataacctggcgaaagtcgggctaatccgaggtaagctgagagtgtggcatcacacaatcagaaaaggtggctctgccatcgtttgaggaggagttcgcggtagattagctagctggtgaggtaatggctcaccagggcaacaatctatagctggtctgagaggacgatcagtcacactggaactgagacacggtccagactcctacgggaggcagcagtggggaatcttccacaatgggcgaaagcctgatggagcaacgccgcgtgaatgaagaaggccttagggtcgtaaagttctgtccttagggaagaaccgtgggtatagtaaatgctacccacctgacggtacctttggaggaagcactggctaactacgtgccagcagccgcggtaatacgtagagtgcaagcgttgtccggaattattgggcgtaaagggtacgcaggcggataatcaagtcaagcgtgaaaggtgtcggcttaaccgacagactgcgtttgaaactggttatcttgagtgtaacagaggagagtggaattcctagtgtagtggtgaaatacgtagatattaggaagaacaccagtggcgaaggcgactctctgggttaacactgacgctgaggtacgaaagctgggggagcgaacgggattagataccccggtagtcccagccgtaaacgatggatactaggtgttggaggttcgaatccttcagtgccggagttaacgcattaagtatcccgcctggggattacgatcgcaagattgaaactcaaaggaattgacgggggcccgcacaagcggtggagcatgtggtttaattcgaagcaacgcgaagaaccttaccgagaattgacatcccgtgaccatctatgagagtagaatttagcactttgtgctacacggagacaggtggtgcatggctgtcgtcagctcgtgtcgtgagatgttgggttaagtcccgcaacgagcgcaacccctattcttagttgccagcgagtaatgtcggggactctaagaagactgccggtgaaagtcggaggaaggtggggatgacgtcaagtcctcatgccctttatatctcgggctacacacgtgctacaatggttgatacagaggggagctaagctgcgaagtggagcaaatccttgaaaatcaatcccagttcggattgcaggctgcaactcgcctgtatgaagttggaatcgctagtaatcgcaggtcagcatactgcggtgaatacgttcccgggccttgtacacaccgcccgtcacaccaatcgagttgggtgcaccagaagtcatctgcggatgccaaaggtgtgcccggcaagaggggtgaagtcgtaacaaggtagccgtaccggaaggtgcggctggatcacctcctttct

SEQ ID NO: 4165 - DNA, 1557 bp, Halanaerobium saccharolyticum
  ref <308>: DATABASE ACCESSION NUMBER: NCBI ACCESSION: NZ_QLME01000047.1
  ref <309>: DATABASE ENTRY DATE: 2019-04-01
  ref <313>: RELEVANT RESIDUES IN SEQ ID NO: (1)..(1557)
tttatatggagagtttgatcctggctcaggacgaacgctggcggcgtgcttaacacatgcaagtcgaacggtctacctcgacagaaaccttcgggttgacgacgagatctagatagtggcggacgggtgagtaacacgtgaataatctgtcctcaagtccgggataacctggcgaaagtcgggctaatccggggtaagctgagagtgtggcatcacacaatcagaaaaggtggctttagccatcgtttgaggaggagttcgcggtagattagctagctggtgaggtaatggctcaccagggcaacaatctatagctggtctgagaggacgatcagtcacactggaactgagacacggtccagactcctacgggaggcagcagtggggaatcttccacaatgggcgaaagcctgatggagcaacgccgcgtgagtgaagaaggtcttaggattgtaaagctctgtccttagggaagaaccgtgggtatagtaaatgctacccacctgacggtacctttggaggaagcactggctaactacgtgccagcagccgcggtaatacgtagagtgcaagcgttgtccggaattattgggcgtaaagggtacgcaggcggataatcaagtcaagcgtgaaaggtgtcggcttaaccgacagactgcgtttgaaactggttatcttgagtgtaacagaggagagtggaattcctagtgtagtggtgaaatacgtagatattaggaagaacaccagtggcgaaggcgactctctgggttaacactgacgctgaggtacgaaagctgggggagcgaacgggattagataccccggtagtcccagccgtaaacgatggatactaggtgttggaggttcgaatccttcagtgccggagttaacgcattaagtatcccgcctggggattacgatcgcaagattgaaactcaaaggaattgacgggggcccgcacaagcggtggagcatgtggtttaattcgaagcaacgcgaagaaccttaccgagaattgacatcccgtgaccatctatgagagtagagtttggcacttagtgccacacggagacaggtggtgcatggctgtcgtcagctcgtgtcgtgagatgttgggttaagtcccgcaacgagcgcaacccctgttcttagttgccagcgagtaatgtcggggactctaagaagactgccggtgaaagtcggaggaaggtggggatgacgtcaagtcctcatgccctttatatctcgggctacacacgtgctacaatggctgatacagaggggagcaaagccgcgaggtggagcaaatcctttaaaatcagtcccagttcggattgcaggctgcaactcgcctgtatgaagttggaatcgctagtaatcgcaggtcagcatactgcggtgaatacgttcccgggccttgtacacaccgcccgtcacaccaatcgagttggatgcaccagaagtcatctgcggatgccaaaggtgtgtccggtaagaggggtgaagtcgtaacaaggtagccgtaccggaaggtgcggctggatcacctcctttcta

SEQ ID NO: 4166 - DNA, 1538 bp, Halieaceae bacterium LZ-16-2
  ref <308>: DATABASE ACCESSION NUMBER: NCBI ACCESSION: NZ_RFLW01000008.1
  ref <309>: DATABASE ENTRY DATE: 2019-04-01
  ref <313>: RELEVANT RESIDUES IN SEQ ID NO: (1)..(1538)
taaactgaagagtttgatcatggctcagattgaacgctggcggcaggcctaacacatgcaagtcgagcgcgaaaggccttcgggttgagtagagcggcggacgggtgagtaacgcgtaggaatctacctggtagtgggggataacttggggaaacccaagctaataccgcatacgccctaagggggaaagcgggggatcttcggacctcgcgctatcggatgagcctgcgtaggattagcttgttggtgaggtaaaggctcaccaaggcgacgatccttagctggtctgagaggatgatcagccacaccgggactgagacacggcccggactcctacgggaggcagcagtggggaatattgcgcaatgggcgaaagcctgacgcagccatgccgcgtgtgtgaagaaggccttcgggttgtaaagcactttcacttgggaagaaaagctgggggctaatacctttcagctgtgacattaccttgagaagaagcaccggctaactccgtgccagcagccgcggtaatacggagggtgcaagcgttaatcggaattactgggcgtaaagcgcgcgtaggcggtttgttaagtcggatgtgaaagccccgggctcaacctgggaactgcacccgatactggccgactagagtacgagagagggaggtagaattccacgtgtagcggtgaaatgcgtagatatgtggaggaataccggtggcgaaggcgacctcctggctcgatactgacgctgaggtgcgaaagcgtggggagcaaacaggattagataccctggtagtccacgccgtaaacgatgtctactagccgttgggagacttgatttcttggtggcgcagctaacgcactaagtagaccgcctggggagtacggccgcaaggttaaaactcaaatgaattgacgggggcccgcacaagcggtggagcatgtggtttaattcgatgcaacgcgaagaaccttaccaggtcttgacatcctcggaactttctagagatagattggtgccttcgggaaccgagagacaggtgctgcatggctgtcgtcagctcgtgtcgtgagatgttgggttaagtcccgtaacgagcgcaacccttgtccttagttgccagcgcgtaatggcgggaactctaaggagactgccggtgacaaaccggaggaaggtggggacgacgtcaagtcatcatggcccttacgacctgggctacacacgtgctacaatggaacgtacagagggcagcaaagcggcgacgtggagcgaatcccacaaaacgtttcgtagtccggatcggagtctgcaactcgactccgtgaagtcggaatcgctagtaatcgtgaatcagaatgtcacggtgaatacgttcccgggccttgtacacaccgcccgtcacaccatgggagtgggttgctccagaagtggttagtctaaccttcggggggacgatcaccacggagtgattcatgactggggtgaagtcgtaacaaggtagccctaggggaacctggggctggatcacctccttaaac

SEQ ID NO: 4167 - DNA, 1535 bp, Halioglobus sp. U0301
  ref <308>: DATABASE ACCESSION NUMBER: NCBI ACCESSION: NZ_QRAN01000047.1
  ref <309>: DATABASE ENTRY DATE: 2019-04-01
  ref <313>: RELEVANT RESIDUES IN SEQ ID NO: (1)..(1535)
gaactgaagagtttgatcatggctcagattgaacgctggcggcaggcctaacacatgcaagtcgagcgagaaagcccttcggggtgagtacagcggcggacgggtgagtaacgcgtaggaatctacctggtagtgggggacaacatgtggaaacgcatgctaataccgcatacgacctaagggtgaaagtgggggaccttcgggcctcacgctaccagatgagcctgcgtaagattagctagttggtggggtaaaggctcaccaaggcgacgatctttagctggtctgagaggatgatcagccacactgggactgagacacggcccagactcctacgggaggcagcagtggggaatattgcgcaatgggggcaaccctgacgcagccatgccgcgtgtgtgaagaaggccctagggttgtaaagcactttcaattgggaggaaaggttgcgtgttaatagcacgtagctgtgacgttacctttagaagaagcaccggctaactccgtgccagcagccgcggtaatacggagggtgcgagcgttaatcggaattactgggcgtaaagcgcgcgtaggcggttgtttaagtcagctgtgaaagccccgggctcaacctgggaattgcagttgatactggatgactagagtacgagagagggaggtagaattccacgtgtagcggtgaaatgcgtagatatgtggaggaataccggtggcgaaggcggcctcctggctcgatactgacgctgaggtgcgaaagcgtggggagcaaacaggattagataccctggtagtccacgccgtaaacgatgtctactagccgttggggaacttgattctttagtggcgcagctaacgcactaagtagaccgcctggggagtacggccgcaaggttaaaactcaaatgaattgacgggggcccgcacaagcggtggagcatgtggtttaattcgatgcaacgcgaagaaccttaccaggtcttgacatacagcgaactttccagagatggattggtgccttcgggaacgctgatacaggtgctgcatggctgtcgtcagctcgtgtcgtgagatgttgggttaagtcccgtaacgagcgcaacccttgtccttagttgccagcacgtcatggtgggaactctagggagactgccggtgacaaaccggaggaaggtggggacgacgtcaagtcatcatggcccttacgacctgggctacacacgtgctacaatggagcgcacagagggcagcaaacccgcgagggggagcgaatcccacaaaacgtttcgtagtccggattggagtctgcaactcgactccatgaagtcggaatcgctagtaatcgtgaatcagaatgtcacggtgaatacgttcccgggccttgtacacaccgcccgtcacaccatgggagtgggttgctccagaagtggttagcctaaccttcgggagggcgatcaccacggagtgattcatgactggggtgaagtcgtaacaaggtagccctaggggaacctggggctggatcacctccttaa

SEQ ID NO: 4168 - DNA, 1517 bp, Haloarcobacter mediterraneus
  ref <308>: DATABASE ACCESSION NUMBER: NCBI ACCESSION: NZ_NXIE01000010.1
  ref <309>: DATABASE ENTRY DATE: 2019-04-01
  ref <313>: RELEVANT RESIDUES IN SEQ ID NO: (1)..(1517)
tttatggagagtttgatcctggctcagagtgaacgctggcggcgtgcctaacacatgcaagtcgaacgagaacggatctagcttgctagattgtcagctaagtggcgcacgggtgagtaatatatagttaacctgccctcgagaaaggaataacagttggaaacgactgctaatgccctatatgcctttaagacagaagtctgcaagggaaatgctttagtgctcgaggatgggactgtacggtatcagatagttggtggggtaatggcctaccaagtcaatgacgcctaactggtttgagaggatgatcagtcacactggaactgagacacggtccagactcctacgggaggcagcagtggggaatattgcacaatggaggaaactctgatgcagcaacgccgcgtggaggatgacacttttcggagcgtaaactccttttatataggaagataatgacggtactatatgaataagcaccggctaactccgtgccagcagccgcggtaatacggagggtgcaagcgttactcggaatcactgggcgtaaagagcgtgtaggcggatagataagtttgaagtgaaatcctatggctcaaccatagaactgctttgaaaactgtctatctagaatatgggagaggtagatggaatttctggtgtaggggtaaaatccgtagagatcagaaggaataccgattgcgaaggcgatctactggaacattattgacgctgagacgcgaaagcgtggggagcaaacaggattagataccctggtagtccacgccctaaacgatgtacactagttgttgctatgctagacatagcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggacttgacatttacagaactttcaagagattgattggtgtctgcttgcagaaactgtaggacaggtgctgcacggctgtcgtcagctcgtgtcgtgagatgttgggttaagtcccgcaacgagcgcaacccacgtcgttagttgctaacagttcggctgagaactctaacgagactgcctacgcaagtaggaggaaggtgtggacgacgtcaagtcatcatggcccttacgtccagggctacacacgtgctacaatggggtatacaaagagcagcgataccgcgaggtggagcaaatctcaaaaatatctcccagttcggatagtactctgcaactcgagtgcttgaagttggaatcgctagtaatcgtagatcagcaatgctacggtgaatacgttcccgggtcttgtactcaccgcccgtcacaccatgggagttgaactcattcgaagcggggatgctaaactagctaccctccacagtggattcagcgactggggtgaagtcgtaacaaggtaaccgtaggagaacctgcggttggatcacctcctttc

SEQ ID NO: 4169 - DNA, 300 bp, Halobacillus dabanensis
  ref <308>: DATABASE ACCESSION NUMBER: NCBI ACCESSION: NZ_FOSB01000002.1
  ref <309>: DATABASE ENTRY DATE: 2019-04-01
  ref <313>: RELEVANT RESIDUES IN SEQ ID NO: (1)..(300)
tttatggagagtttgatcctggctcaggacgaacgctggcggcgtgcctaatacatgcaagtcgagcgcgggaagcgagtggatcctcatctgaggtgaagctcgtggaacgagcggcggacgggtgagtaacacgtgggcaacctgcctgtaagaccggaataaccccgggaaaccggggctaatgccgggtaatacttttcttcgcatgaaggaaagttgaaagatggcttcttgctatcacttacagatgggcccgcggcgcattagctagttggtgaggtaacggctcaccaaggc

SEQ ID NO: 4170 - DNA, 1572 bp, Halobacillus hunanensis
  ref <308>: DATABASE ACCESSION NUMBER: NCBI ACCESSION: NZ_FVZB01000005.1
  ref <309>: DATABASE ENTRY DATE: 2019-04-01
  ref <313>: RELEVANT RESIDUES IN SEQ ID NO: (1)..(1572)
ttttatggagagtttgatcctggctcaggacgaacgctggcggcgtgcctaatacatgcaagtcgagcgcaggaagcaggcagatccccttcgggggtgatgcctgtggaatgagcggcggacgggtgagtaacacgtgggcaacctgcctgtaagatcggaataactccgggaaaccggggctaatgccgggtaatcctttttttcgcatgagagagaggtaaaagatggcctttggctatcacttacagatgggcccgcggcgcattagctagttggtgaggtaatagctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgtgcgaatagagcggtaccttgacggtacctaacgaggaagccccggctaactacgtgccagcagccgcggtaatacgtagggggcaagcgttgtccggaattattgggcgtaaagcgcgcgcaggcggtttcttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggaccgccctagagatagggtcttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcaaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttatggagccagccgccgaaggtggggccaatgattggggtgaagtcgtaacaaggtagccgtatcggaaggtgcggctggatcacctcctttctaa

SEQ ID NO: 4171 - DNA, 307 bp, Halobacillus karajensis
  ref <308>: DATABASE ACCESSION NUMBER: NCBI ACCESSION: NZ_FNWW01000002.1
  ref <309>: DATABASE ENTRY DATE: 2019-04-01
  ref <313>: RELEVANT RESIDUES IN SEQ ID NO: (1)..(307)
tttatggagagtttgatcctggctcaggacgaacgctggcggcgtgcctaatacatgcaagtcgagcgcgggaagcgagtggatcccttcggggtgaagctcgtggaacgagcggcggacgggtgagtaacacgtgggcaacctgcctgtaagaccggaataaccccgggaaaccggggctaatgccgggtaatacttttcttcgcatgaaggaaagttgaaagatggcttcttgctatcacttacagatgggcccgcggcgcattagctagttggtgaggtaacggctcaccaaggcgacgatgcg

SEQ ID NO: 4172 - DNA, 418 bp, Halobacillus kuroshimensis
  ref <308>: DATABASE ACCESSION NUMBER: NCBI ACCESSION: NZ_AUDY01000014.1
  ref <309>: DATABASE ENTRY DATE: 2019-04-01
  ref <313>: RELEVANT RESIDUES IN SEQ ID NO: (1)..(418)
tttatggagagtttgatcctggctcaggacgaacgctggcggcgtgcctaatacatgcaagtcgagcgcgggaagcgagtggatcccttcggggtgaagctcgtggaacgagcggcggacgggtgagtaacacgtgggcaacctgcctgtaagatcggaataaccccgggaaaccggggctaatgccgggtaatacttttcttcgcatgaagataagttgaaagatggcttctcgctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaa

SEQ ID NO: 4173 - DNA, 1570 bp, Halobacillus mangrovi
  ref <308>: DATABASE ACCESSION NUMBER: NCBI ACCESSION: NZ_CP020772.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcgggaagcgagctgatccccttcgggggtgacgctcgtggaacgagcggcggacgggtgagtaacacgtgggcaacctgcctgtaagaccggaataaccccgggaaaccggggctaatgccgggtaacactttcttccgcatggaggagagttgaaagatggcttttagctatcacttacagatgggcccgcggcgcattagctagttggtgaggtaaaggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgtgcgaatagagcggtaccttgacggtacctaacgaggaagccccggctaactacgtgccagcagccgcggtaatacgtagggggcaagcgttgtccggaattattgggcgtaaagcgcgcgcaggcggtttcttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtctctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggacctccctagagatagggatttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaaccatttggagccagccgccgaaggtggggccaatgattggggtgaagtcgtaacaaggtagccgtatcggaaggtgcggctggatcacctcctttctaa

SEQ ID NO: 4174 - DNA, 1570 bp, Halobacillus massiliensis
  ref <308>: DATABASE ACCESSION NUMBER: NCBI ACCESSION: NZ_LT800499.1
  ref <309>: DATABASE ENTRY DATE: 2019-04-01
  ref <313>: RELEVANT RESIDUES IN SEQ ID NO: (1)..(1570)
tttttggagagtttgatcctggctcaggacgaacgctggcggcgtgcctaatacatgcaagtcgagcgcaggaagctaaccgatccccttcgggggtgacgttagtggaatgagcggcggacgggtgagtaacacgtgggcaacctgcctgtaagaccggaataaccccgggaaaccggggctaatgccggataacctcttctctctcatgaggaaagagtaaaagatggcctttggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgtgagggaagaacaagtaccgtgcgaatagagcggtaccttgacggtacctcacgagaaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggaccgccctagagatagggtcttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagaatgccgcggtgaatacgttcccgggccttgtacacaccgcccgtcacaccacgagagttggcaacacccgaagtcggtgaggtaacctttatggagccagccgccgaaggtggggccaatgattggggtgaagtcgtaacaaggtagccgtatcggaaggtgcggctggatcacctcctttcta

SEQ ID NO: 4175 - DNA, 1572 bp, Halobacillus salinus
  ref <308>: DATABASE ACCESSION NUMBER: NCBI ACCESSION: NZ_FVYZ01000003.1
  ref <309>: DATABASE ENTRY DATE: 2019-04-01
  ref <313>: RELEVANT RESIDUES IN SEQ ID NO: (1)..(1572)
ttttatggagagtttgatcctggctcaggacgaacgctggcggcgtgcctaatacatgcaagtcgagcgcaggaagcgagctgatccccttcgggggtgacgctcgtggaatgagcggcggacgggtgagtaacacgtgggcaacctgcctgtaagatcggaataactccgggaaaccggagctaatgccgggtaacatgttccttcgcatgaagggacattaaaagatggcttctcgctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgtgcgaatagaacggtaccttgacggtacctaacgaggaagccccggctaactacgtgccagcagccgcggtaatacgtagggggcaagcgttgtccggaattattgggcgtaaagcgcgcgcaggcggttccttaagtctgatgtgaaaggccacggctcaaccgtggagggccattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctttggaccaccctagagatagggtcttcccttcggggaccaaatgacaggtggtgcatggttgtcgtcagctcgtgtcgtgagatgttgggttaagtcccgcaacgagcgcaacccctaatcttagttgccagcatttagttgggcactctaaggtgactgccggtgacaaaccggaggaaggcggggatgacgtcaaatcatcatgccccttatgacctgggctacacacgtgctacaatggatggaacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttctaa

SEQ ID NO: 4176 - DNA, 1568 bp, Halobacillus sp. BAB-2008
  ref <308>: DATABASE ACCESSION NUMBER: NCBI ACCESSION: NZ_ANPF01000133.1
  ref <309>: DATABASE ENTRY DATE: 2019-04-01
  ref <313>: RELEVANT RESIDUES IN SEQ ID NO: (1)..(1568)
tttatggagagtttgatcctggctcaggacgaacgctggcggcgtgcctaatacatgcaagtcgagcgcgggaagcgagctgatcccttcggggtgacgctcgtggaacgagcggcggacgggtgagtaacacgtgggcaacctgcctgtaagatcgggataactccgggaaaccggggctaataccgggtaacactttctttcgcatgaaggaaagttgaaagatggcttctcgctatcacttacagatgggcccgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgtgcgaatagagcggtaccttgacggtacctaacgaggaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggacctccctagagatagggatttcccttcggggaccaagtgacaggtggtgcatggttgtcgtcagctcgtgtcgtgagatgttgggttaagtcccgcaacgagcgcaacccctgatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 4177 - DNA, 1571 bp, Halobacillus sp. BBL2006
  ref <308>: DATABASE ACCESSION NUMBER: NCBI ACCESSION: NZ_JRNX01001001.1
  ref <309>: DATABASE ENTRY DATE: 2019-04-01
  ref <313>: RELEVANT RESIDUES IN SEQ ID NO: (1)..(1571)
tttatggagagtttgatcctggctcaggacgaacgctggcggcgtgcctaatacatgcaagtcgagcgcgggaagcgagctgatccccttcgggggtgacgctcgtggaacgagcggcggacgggtgagtaacacgtgggcaacctgcctgtaagatcggaataaccccgggaaaccggggctaatgccgggtaacactttccttcgcatgaaggagagttgaaagatggcttcttgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgtgcgaatagagcggtaccttgacggtacctaacgaggaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggacctccctagagatagggatttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttctaa

SEQ ID NO: 4178 - DNA, 1568 bp, Halobacillus sp. KGW1
  ref <308>: DATABASE ACCESSION NUMBER: NCBI ACCESSION: NZ_LSOC01000009.1
  ref <309>: DATABASE ENTRY DATE: 2019-04-01
  ref <313>: RELEVANT RESIDUES IN SEQ ID NO: (1)..(1568)
tttatggagagtttgatcctggctcaggacgaacgctggcggcgtgcctaatacatgcaagtcgagcgcgggaagcgagctgatcccttcggggtgacgctcgtggaacgagcggcggacgggtgagtaacacgtgggcaacctgcctgtaagatcgggataactccgggaaaccggggctaataccgggtaatactttctttcgcatgaaggaaagttgaaagatggcttctcgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgtgcgaatagagcggtaccttgacggtacctaacgaggaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgaggacagaagaggagagtggaattccacgtgtagcggtgaaatgcgtagatatgtggaggaacaccagtggcgaaggcgactctctggtctgtttctgacgctgaggtgcgaaagcgtgggtagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggacctccctagagatagggatttcccttcggggaccaagtgacaggtggtgcatggttgtcgtcagctcgtgtcgtgagatgttgggttaagtcccgcaacgagcgcaacccctgatcttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 4179 - DNA, 1546 bp, Halobacteroides halobius
  ref <308>: DATABASE ACCESSION NUMBER: NCBI ACCESSION: NC_019978.1
  ref <309>: DATABASE ENTRY DATE: 2019-04-01
  ref <313>: RELEVANT RESIDUES IN SEQ ID NO: (1)..(1546)
tttattcggagagtttgatcctggctcaggacgaacgctggcggcgtgcttaacacatgcaagttgtgcgagaaagttaccttcgggtaacaagtaaagcagcgaacgggtgagtaacgcgtaagtatctacctttaagtctgggataactcttcgaaagaggggctaataccagatatactcctttggaggaaagatggtattactattgcttaaagatgagcttgcgtcccattagctagttggtgagataacagctcaccaaggcaacgatgggtagccgacctgagagggtgatcggccacactgggactgagacacggcccagactcctacgggagggctgcagtggggaatcttccgcaatgggcgaaagcctgacggagcaacgccgcgtgagtgatgaaggccttagggtcgtaaagctctgtctttagggaagaacactttagtagtgaataactgctagaattgacggtacctttaaaggaagccccggctaattacgtgccagcagccgcggtaacacgtaaggggctagcgttgtccggaattactgggcgtaaagggtacgcaggcggtctagcaagtcagaggtgaaatccattggcttaaccaatgaagtgcctttgaaactgttagacttgagagcaagagaggaagatggaattcctggtgtagtggtgaaatacgtagatatcaggaagaataccaatggcgaaagcagtcttctggcttgactctgacgctgaggtacgaaagctagggtatcaaacgggattagataccccggtagtcctagctgtaaacgctggatactaggtgttggaggttcaactccttcggtgccgtagttaacgctttaagcatcccacctggggagtacgccggcaacggtgaaactcaaaggaattgacgggggcccgcacaagcggaggaacatgtggtttaattcgatgatacgcgaagaaccttaccagaacttgacatccctgtgatcgttctttaacaagaacttttccttttggaacacagatgacaggtggtgcatggctgtcgtcagctcgtgtcgtgagatgttgggttaagtcccgcaacgagcgtaacccctattcttagttgccagcatgtagtgatggggactctaagaagactgccgcgggagcaacgcggaggaaggtggggatgacgtcaagtcatcatgccccttatgttctgggctacacacgtgctacaatggtttatacagaggggagcgaagccgcaaggtggagcaaatccccaaaagtagacctcagttcggattgcagattgcaactcatctgcatgaagctggagtcgctagtaatcgtggatcagaatgccacggtgaatccgttctcgggccttgtacacaccgcccgtcacaccacccgagttgggggcaccagaagtcactgacctaacttttagaaggaagtgccgaaggtgtgcccgataaggggggtgaagtcgtaacaaggtagccgtaccggaaggtgcggctggatcacctcctttctaagga

SEQ ID NO: 4180 - DNA, 1551 bp, Halocella sp. SP3-1
  ref <308>: DATABASE ACCESSION NUMBER: NCBI ACCESSION: NZ_CP032760.1
  ref <309>: DATABASE ENTRY DATE: 2019-04-01
  ref <313>: RELEVANT RESIDUES IN SEQ ID NO: (1)..(1551)
ttaatggagagtttgatcctggctcaggacgaacgctggcggcgtgcttaacacatgcaagtcgaacgacccgccttaacagattccttcgggatgaagataagatccgggtagtggcggacgggtgagtaacgcgtggagaacctgtctctcagtcagggataacctggcgaaagccggactaatcccagatagccttaagagtaagcatttacacttaagtaaaggtgcctaggcatcgctgagaggtggctccgcgtcggattagctagctggtgaggtaatagctcaccagggcaacgatccgtagctggtctgagaggacgatcagccacactgggactgagacacggcccagactcctacgggaggcagcagtggggaatcttccgcaatgggcgcaagcctgacggagcaacgccgcgtgagtgatgaaggccttcgggtcgtaaagctctgtccttaaggaagaaccgtcaatgcaggaaatggcattgacctgacggtacttaaggaggaagctctggctaactacgtgccagcagccgcggtaatacgtagagagcaagcgttgtccggaattactgggcgtaaagggtacgcaggcggataggcaagtcaactgtgaaatataccggcttaaccggtaaggtgcatttgaaactgcctatcttgagtgcagaagaggagagcggaattcctagtgtagcggtggaatgcgtagatattaggaagaacaccagtggcgaaggcggctctctggtctgcaactgacgctgaggtacgaaagctgggggagcaaacgggattagataccccggtagtcccagccgtaaacgatggacactaggtgttggtggttcgaatccatcagtgccggagttaacgcgataagtgtcccgcctggggattacggtcgcaagactgaaactcaaaggaattgacgggggcccgcacaagcggtggagcatgtggtttaattcgatgcaacgcgaagaaccttaccgaggcttgacatcccgtgaccatctatgaaagtagagtctagtctttgactacacggagacaggtggtgcatggctgtcgtcagctcgtgtcgtgagatgttgggttaagtcccgcaacgagcgcaacccttatccttagttaccagcaagtaaagttggggactctaaggagacagccggtgaaagccggaggaaggtggggatgacgtcaagtcctcatgccctttatgcctcgggctacacacgtgctacaatggtcagtacagaggggagcgaagctgtgaagtggagcaaatctcagaaagctgatcccagttcggattgcaggctgaaactcgcctgtatgaagttggaatcgctagtaatcgcaggtcagcatactgcggtgaatacgttcccgggccttgtacacaccgcccgtcacaccacccgagttagatgcaccagaagtcatttgcgaatgccaaaggtgtgtctggtaaggggggtgaagtcgtaacaaggtagccgtacgggaacgtgcggctggatcacctcctttcta

SEQ ID NO: 4181 - DNA, 1476 bp, Halocynthiibacter arcticus
  ref <308>: DATABASE ACCESSION NUMBER: NCBI ACCESSION: NZ_CP014327.1
  ref <309>: DATABASE ENTRY DATE: 2019-04-01
  ref <313>: RELEVANT RESIDUES IN SEQ ID NO: (1)..(1476)
tcaacttgagagtttgatcctggctcagaacgaacgctggcggcacgcctaacacatgcaagtcgagcgcttcccttcggggaggagcggcggacgggttagtaacgcgtgggaacatacccttcactaaggaatagccactggaaacggtgagtaataccttatacgcccttcgggggaaagatttatcggtgaaggattggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagcgatgccgcgtgagtgacgaaggccttagggtcgtaaagctctttcaccagggatgataatgacagtacctggaaaagaaaccccggctaactccgtgccagcagccgcggtaatacggagggggttagcgttgttcggaattactgggcgtaaagcgcacgtaggcggattagtaagttagaggtgaaatcccagggctcaaccctggaactgcctttaatactgctagtcttgagttcgagagaggtaagtggaattccgagtgtagaggtgaaattcgtagatattcggaggaacaccagtggcgaaggcgacttactggctcgatactgacgctgaggtgcgaaagcgtggggagcaaacaggattagataccctggtagtccacgccgtaaacgatgaatgccagtcgttagcaagcatgcttgttagtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatactcgtcgtcgctccagagatggagctttcagctaggctggacgagatacaggtgctgcatggctgtcgtcagctcgtgtcgtgagatgttcggttaagtccggcaacgagcgcaacccacgtccttagttgccagcaggttaagctgggcactctagggagactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaaggccgtgcgccaacctgcttgcaggaggcagcggaccacggtgggttcagcgactggggtgaagtcgtaacaaggtagccgtaggggaacctgcggctggatcacctcctttctaa

SEQ ID NO: 4182 - DNA, 1473 bp, Halocynthiibacter namhaensis
  ref <308>: DATABASE ACCESSION NUMBER: NCBI ACCESSION: NZ_JWIF01000056.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcacgcctaacacatgcaagtcgagcgcttcccttcggggaggagcggcggacgggttagtaacgcgtgggaacatgccctttactaaggaatagcctcgggaaactgagagtaataccttatacgcccttcgggggaaagatttatcggtaaaggattggcccgcgtaagattagatagttggtggggtaacggcctaccaagtcgacgatctttagctggtttgagaggatgatcagcaacactgggactgagacacggcccagactcctacgggaggcagcagtggggaatcttagacaatgggcgcaagcctgatctagcgatgccgcgtgagtgatgaaggccttagggtcgtaaaactctttcaccagggatgataatgacagtacctggaaaagaaaccccggctaactccgtgccagcagccgcggtaatacggagggggttagcgttgttcggaattactgggcgtaaagcgtacgtaggcggattagtaagttaggggtgaaatcccagggctcaaccctggaactgcctttaatactgctagtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcagcaagcatgcttgttggtgacacacctaacggattaagcattccgcctggggagtacggtcgcaagattaaaactcaaaggaattgacgggggcccgcacaagcggtggagcatgtggtttaattcgacgcaacgcgcagaaccttaccaacccttgacatactcgtcgtcggtccagagatggatctttcagttcggctggacgagatacaggtgctgcatggctgtcgtcagctcgtgtcgtgagatgttcggttaagtccggcaacgagcgcaacccacgtccttagttgccagcaggttaagctgggcactctagggaaactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggatctacccgaaggccgtgcgccaacctttcgagggggcagcggaccacggtgggttcagcgactggggtgaagtcgtaacaaggtagccctaggggaacctggggctggatcacctcctttctaa

SEQ ID NO: 4183 - DNA, 1075 bp, Halodesulfovibrio aestuarii
  ref <308>: DATABASE ACCESSION NUMBER: NCBI ACCESSION: NZ_AULY01000005.1
  ref <309>: DATABASE ENTRY DATE: 2019-04-01
  ref <313>: RELEVANT RESIDUES IN SEQ ID NO: (1)..(1075)
ttagcaattgacggtacctctagaggaagcaccggctaattcagtgccagcagccgcggtaatactgaaggtgcaagcgttaatcggaatcactgggcgtaaagcgctcgtaggtggctttgtaagtcaggtgtgaaagcccacggctcaaccgtggaattgcacttgatactgcatcgctagagtataggagagggaagtggaatttctggtgtaggagtgaaatccgtagagatcagaaggaacaccggtggcgaaggcgacttcctggactattactgacactgaggagcgaaagcgtggggagcaaacaggattagataccctggtagtccacgccgtaaacgatgggtactaagtgtcggaggcttgaccttcggtgctgtagttaacgcgttaagtaccccgcctggggagtacggtcgcaaggctgaaactcaaagaaattgacgggggcccgcacaagcggtggagtatgtggtttaattcgatgcaacgcgaagaaccttacccaggcttgacatcctgcgaatgcccaagaaattaggcagtgcccttcggggaatgcagtgacaggtgctgcatggctgtcgtcagctcgtgccgtgaggtgttgggttaagtcccgcaacgagcgcaacccctatccttagttgccaccaggtaatgctgagcactctagggagactgcccgggttaaccgggaggaaggtggggacgacgtcaagtcatcatggcccttacgcctggggctacacacgtactacaatggtgcatacaaagggttgcgataccgtgaggtggagctaatcccataaagtgcatcccagtccggataggagtctgcaactcgactccttgaagtcggaatcgctagtaatcccggatcagcatgccggggtgaatgcgttcccgggccttgtacacaccgcccgtcacaccacgaaagttggttctacccgaaaccagtgagctaaccagcaatggaggcagctgtctacggtggggctgatgattggggtgaagtcgtaacaaggtagccgtaggggaacctgcggctggatcacctccttta

SEQ ID NO: 4184 - DNA, 1547 bp, Halodesulfovibrio marinisediminis
  ref <308>: DATABASE ACCESSION NUMBER: NCBI ACCESSION: NZ_FSRG01000001.1
  ref <309>: DATABASE ENTRY DATE: 2019-04-01
  ref <313>: RELEVANT RESIDUES IN SEQ ID NO: (1)..(1547)
ttaaactggagagtttgattctggctcagattgaacgctggcggcgtgcctaacacatgcaagtcgaacgcgaaagtttcttcggaaacgagtagagtggcgcacgggtgagtaacgcgtggattatctacctactggtacgggacaacagttggaaacgactgctaataccgtatacgctggtaacgggaaagggggcctcttcttgaaagctctcgccagtagatgagtccgcgtttcattagctagacggtggggtaacggcctaccgtggcaacgatgaatagcaggcctgagagggtggcctgccacactgggactggaacacggcccagactcctacgggaggcagcagtggggaatattgcgcaatggacgaaagtctgacgcagcgacgccgcgtggaggatgaaggttttcggatcgtaaactcctgtcaagagggaagaaacctattaagattaatactcttagtaattgacggtacctctagaggaagcaccggctaattcagtgccagcagccgcggtaatactgaaggtgcaagcgttaatcggaatcactgggcgtaaagcgctcgtaggtggctttgtaagtcaggtgtgaaagcccacggctcaaccgtggaattgcacttgatactgcatcgctagagtataggagagggaagtggaatttctggtgtaggagtgaaatccgtagagatcagaaggaacacccgtggcgaaggcgacttcctggactattactgacactgaggagcgaaagcgtggggagcaaacaggattagataccctggtagtccacgccgtaaacgatgggtactaggtgttgggggcttgaccctcggtgccgtagttaacgcgttaagtaccccgcctggggagtacggtcgcaaggctgaaactcaaagaaattgacgggggcccgcacaagcggtggagtatgtggtttaattcgatgcaacgcgaagaaccttacccaggcttgacatcctgcgaatgcccaagaaattaggcagtgcccttcggggaatgcagtgacaggtgctgcatggctgtcgtcagctcgtgccgtgaggtgttgggttaagtcccgcaacgagcgcaacccctatccttagttgccaccaggtaatgctgagcactctagggagactgcccgggttaaccgggaggaaggtggggacgacgtcaagtcatcatggcccttacgcctggggctacacacgtactacaatggtgcatacaaagggttgcgataccgtgaggtggagctaatcccagaaagtgcatcccagtccggataggagtctgcaactcgactccttgaagtcggaatcgctagtaatcccggatcagcatgccggggtgaatgcgttcccgggccttgtacacaccgcccgtcacaccacgaaagttggttctacccgaaaccagtgagctaaccagcaatggaggcagctgtctacggtggggctgatgattggggtgaagtcgtaacaaggtagccgtaggggaacctgcggctggatcacctcctttaaa

SEQ ID NO: 4185 - DNA, 1548 bp, Halodesulfovibrio spirochaetisodalis
  ref <308>: DATABASE ACCESSION NUMBER: NCBI ACCESSION: NZ_JXMS01000003.1
  ref <309>: DATABASE ENTRY DATE: 2019-04-01
  ref <313>: RELEVANT RESIDUES IN SEQ ID NO: (1)..(1548)
attaaactggagagtttgattctggctcagattgaacgctggcggcgtgcctaacacatgcaagtcgaacgcgaaagtctcttcggagatgagtagagtggcgcacgggtgagtaacgcgtggattatctacctactggtacgggacaacagttggaaacgactgctaataccgtatacgctggtaacgggaaagggggcctcttcttgaaagctctcgccagtagatgagtccgcgtttcattagctagacggtggggtaacggcctaccgtggcaacgatgaatagcaggcctgagagggtggcctgccacactgggactggaacacggcccagactcctacgggaggcagcagtggggaatattgcgcaatggacgaaagtctgacgcagcgacgccgcgtggaggatgaaggttttcggatcgtaaactcctgtcaagagggaagaaacctatcaagactaatactcttagtaattgacggtacctctagaggaagcaccggctaattcagtgccagcagccgcggtaatactgaaggtgcaagcgttaatcggaatcactgggcgtaaagcgctcgtaggtggctttgtaagtcaggtgtgaaagcccacggctcaaccgtggaattgcacttgatactgcatcgctagagtataggagagggaagtggaatttctggtgtaggagtgaaatccgtagagatcagaaggaacacccgtggcgaaggcgacttcctggactattactgacactgaggagcgaaagcgtggggagcaaacaggattagataccctggtagtccacgccgtaaacgatgggtactaggtgttgggggcttgaccctcggtgccgtagttaacgcgttaagtaccccgcctggggagtacggtcgcaaggctgaaactcaaagaaattgacgggggcccgcacaagcggtggagtatgtggtttaattcgatgcaacgcgaagaaccttacccaggcttgacatcctgcgaatgcccaagaaattaggcagtgcccttcggggaatgcagtgacaggtgctgcatggctgtcgtcagctcgtgccgtgaggtgttgggttaagtcccgcaacgagcgcaacccctatccttagttgccaccaggtaatgctgagcactctagggagactgcccgggttaaccgggaggaaggtggggacgacgtcaagtcatcatggcccttacgcctggggctacacacgtactacaatggtacatacaaagggttgcgagaccgtgaggtggagctaatcccaaaaagtgtatcccagtccggataggagtctgcaactcgactccttgaagtcggaatcgctagtaatcccggatcagcatgccggggtgaatgcgttcccgggccttgtacacaccgcccgtcacaccacgaaagttggttctacccgaaaccagtgagctaaccggcaacggaggcagctgtctacggtggggctgatgattggggtgaagtcgtaacaaggtagccgtaggggaacctgcggctggatcacctcctttaaa

SEQ ID NO: 4186 - DNA, 1147 bp, Halolactibacillus alkaliphilus
  ref <308>: DATABASE ACCESSION NUMBER: NCBI ACCESSION: NZ_FOWN01000065.1
  ref <309>: DATABASE ENTRY DATE: 2019-04-01
  ref <313>: RELEVANT RESIDUES IN SEQ ID NO: (1)..(1147)
cttcggggtgatactttgtggaatgagcggcggacgggtgagtaacacgtgggcaacctacctataagactgggataactcatggaaacaggagctaataccggataaccggtgcgttcgcatgaacgcactttaaaaggcggcatttgctgtcacttatagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacacgtaccgttcgaatagggcggtatcttgacggtacctaacgagaaagccccggctaactacgtgccagcagccgcggtaatacgtagggggcaagcgttgtccggaattattgggcgtaaagcgcgcgcaggcggtcctttaagtctgatgtgaaatcttgcggctcaaccgcaagcggtcattggaaactgggggacttgagtacagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacacccctagagatagggcgttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgcccct

SEQ ID NO: 4187 - DNA, 1569 bp, Halolactibacillus halophilus
  ref <308>: DATABASE ACCESSION NUMBER: NCBI ACCESSION: NZ_FOXC01000067.1
  ref <309>: DATABASE ENTRY DATE: 2019-04-01
  ref <313>: RELEVANT RESIDUES IN SEQ ID NO: (1)..(1569)
ttattgagagtttgatcttggctcaggacgaacgctggcggcgtgcctaatacatgcaagtcgagcgcaggaagctgaacagaccccttcggggtgacgatcagtggaatgagcggcggacgggtgagtaacacgtgggcaacctacctataagactgggataactcgtggaaacatgggctaataccggataaccagtgcgttcacatgaacacactttaaaaggcggcttttagctgtcacttatagatgggcccgcggcgcattagctagttggtgaggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacaagtaccgttcaaatagggcggtaccttgacggtacctgacgagaaagccccggctaactacgtgccagcagccgcggtaatacgtagggggcaagcgttgtccggaattattgggcgtaaagcgcgcgcaggcggtctcttaagtctgatgtgaaatcttgcggctcaaccgcaagcggtcattggaaactgggggacttgagtacagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacactcctagagataggacgttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggccgcaagaccgcgaggtttagcaaatcccataaaaccattctcagttcggattgtaggctgcaactcgcctacatgaagccggaatcgctagtaatcgtggatcagcatgccacggtgaatacgttcccgggtcttgtacacaccgcccgtcacaccacgagagtttgtaacacccgaagtcggtgaggtaaccttttggagccagccgccgaaggtgggacaaatgattggggtgaagtcgtaacaaggtagccgtatcggaaggtgcggctggatcacctcctttctaa

SEQ ID NO: 4188 - DNA, 1572 bp, Halolactibacillus miurensis
  ref <308>: DATABASE ACCESSION NUMBER: NCBI ACCESSION: NZ_FPAI01000050.1
  ref <309>: DATABASE ENTRY DATE: 2019-04-01
  ref <313>: RELEVANT RESIDUES IN SEQ ID NO: (1)..(1572)
attttattgagagtttgatcttggctcaggacgaacgctggcggcgtgcctaatacatgcaagtcgagcgcaggaagctaaactgaccccttcggggtgacgattagtggaatgagcggcggacgggtgagtaacacgtgggcaacctacctataagactgggataactcgtggaaacatgggctaataccggataaccagtgtgttcgcatgaacacactttaaaaggcggcttttagctgtcacttatagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacacgtaccgttcgaatagggcggtatcttgacggtacctaacgagaaagccccggctaactacgtgccagcagccgcggtaatacgtagggggcaagcgttgtccggaattattgggcgtaaagcgcgcgcaggcggtcttttaagtctgatgtgaaatcttgcggctcaaccgcaagcggtcattggaaactgggagacttgagtacagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacactcctagagataggacgttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggccgcgagaccgcgaggttcagcaaatcccataaaaccattctcagttcggattgtaggctgcaactcgcctacatgaagccggaatcgctagtaatcgtggatcagcatgccacggtgaatacgttcccgggtcttgtacacaccgcccgtcacaccacgagagtttgtaacacccgaagtcggtgaggtaaccttttggagccagccgccgaaggtgggacaaatgattggggtgaagtcgtaacaaggtagccgtatcggaaggtgcggctggatcacctcctttctaa

SEQ ID NO: 4189 - DNA, 1571 bp, Halolactibacillus sp. JCM 19043
  ref <308>: DATABASE ACCESSION NUMBER: NCBI ACCESSION: NZ_BAXD01000074.1
  ref <309>: DATABASE ENTRY DATE: 2019-04-01
  ref <313>: RELEVANT RESIDUES IN SEQ ID NO: (1)..(1571)
attttattgagagtttgatcttggctcaggacgaacgctggcggcgtgcctaatacatgcaagtcgagcgcaggaagctaaactgacccttcggggtgacgattagtggaatgagcggcggacgggtgagtaacacgtgggcaacctacctataagactgggataactcgtggaaacatgggctaataccggataaccagtgtgttcgcatgaacacactttaaaaggcggcttttagctgtcacttatagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacacgtaccgttcgaatagggcggtatcttgacggtacctaacgagaaagccccggctaactacgtgccagcagccgcggtaatacgtagggggcaagcgttgtccggaattattgggcgtaaagcgcgcgcaggcggtcttttaagtctgatgtgaaatcttgcggctcaaccgcaagcggtcattggaaactgggagacttgagtacagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacactcctagagataggacgttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggccgcgagaccgcgaggttcagcaaatcccataaaaccattctcagttcggattgtaggctgcaactcgcctacatgaagccggaatcgctagtaatcgtggatcagcatgccacggtgaatacgttcccgggtcttgtacacaccgcccgtcacaccacgagagtttgtaacacccgaagtcggtgaggtaaccttttggagccagccgccgaaggtgggacaaatgattggggtgaagtcgtaacaaggtagccgtatcggaaggtgcggctggatcacctcctttctaa

SEQ ID NO: 4190 - DNA, 1491 bp, Halomicronema excentricum
  ref <308>: DATABASE ACCESSION NUMBER: NCBI ACCESSION: NZ_QVFV01000001.1
  ref <309>: DATABASE ENTRY DATE: 2019-04-01
  ref <313>: RELEVANT RESIDUES IN SEQ ID NO: (1)..(1491)
aacatggagagtttgatcctggctcaggatgaacgctggcggcgtgcttaacacatgcaagtcgaacgaaccttttcggaggtgagtggcgaacgggtgagtaacgcgtgaggatctgcccttaggtgggggacaaccgttggaaacgacggctaataccgcatatggcgagagctgaaagatttattgcctagggatgaactcgcgtctgattagctagttggtgaagtaatggtttaccaaggcgacgatcagtagctggtctgagaggatgatcagccacactgggactgagacacggcccagactcctacgggaggcagcagtggggaattttccgcaatgggggcaaccctgacggagcaacgccgcgtgggggaggaatgtctgtggattgtaaaccccttttctcagggaagaagttctgacggtacctgaggaatcagcatcggctaactccgtgccagcagccgcggtaagacggaggatgcaagcgttatccggaattattgggcgtaaagcgtccgtaggcggtttatcaagtctgtcgttaaagactgcagcttaactgtgggcgagcggtggaaactgattaactagagagtggtaggggtagagggaattcccagtgtagcggtgaaatgcgtagatattgggaagaacaccagtggcgaaggcgctctactgggccacaactgacgctgagggacgaaagctaggggagcgaaagggattagatacccctgtagtcctagctgtaaacgatggatactaggtgttgcgcgtatcgacccgtgcagtaccgcagccaacgcgataagtatcccgcctggggagtacgcacgcaagtgtgaaactcaaaggaattgacgggggcccgcacaagcggtggagtatgtggtttaattcgatgcaacgcgaagaaccttaccagggcttgacatcccgcgaatccctttgaaagaggggagtgccttcgggaacgcggagacaggtggtgcatggctgtcgtcagctcgtgtcgtgagatgttgggttaagtcccgcaacgagcgcaacccacgtccttagttgccatcattcagttgggcactctggggagactgccggggacaactcggaggaaggtgtggatgacgtcaagtcatcatgccccttacgttctgggctacacacgtactacaatgcttcggacaaagggcagcgagcgcgcgagcgtgagcaaatctcataaaccgaggcacagttcagattgcaggctgcaactcgcctgcatgaaggaggaatcgctagtaatcgcaggtcagcatactgcggtgaatacgttcccgggccttgtacacaccgcccgtcacaccatgggagttggccacgcccgaagccgttaccctaaccattcgtggaggggggcgtcgaaggtggggctgatgactggggtgaagtcgtaacaaggtagccgtaccggaaggtgtggctggatcacctcctttt

SEQ ID NO: 4191 - DNA, 1494 bp, Halomicronema hongdechloris
  ref <308>: DATABASE ACCESSION NUMBER: NCBI ACCESSION: NZ_CP021983.1
  ref <309>: DATABASE ENTRY DATE: 2019-04-01
  ref <313>: RELEVANT RESIDUES IN SEQ ID NO: (1)..(1494)
aatggagagtttgatcctggctcaggatgaacgctggcggcgtgcttaacacatgcaagtcgaacgggctcttcggagctagtggcggacgggtgagtaacgcgtgaggatctgtccttaggagggggataacattgggaaactgatgctaataccccatatgccgagaggtgaaagagtgaattctgcctgagggtgagctcgcgtcggattagctagttggtgcggtaatggcgtaccaaggcgacgatccgtagctggtctgagaggatgatcagccacactgggactgagacacggcccagactcctacgggaggcagcagtggggaattttccgcaatgggggcaaccctgacggagcaacgccgcgtgcgggaggacggccctagggttgtaaaccgcttttctcagggaagaaggactgacggtacctgaggaataagcctcggctaactccgtgccagcagccgcggtaagacggaggaggcaagcgttatccggaattattgggcgtaaagcgtccgtaggcggctagtcaagtctgctgtcaaagttcagggcttaactctgagtcggcggtggaaactgagtagctagagagcggcaggggtagagggaattcccagtgtagcggtgaaatgcgtagatattgggaagaacaccagtggcgaaggcgctctactgggccgttactgacgctgagggacgaaagctaggggagcgaaagggattagatacccctgtagtcctagctgtaaacgatggatactaggtgttggccgtatcgacccggtcagtaccgaagcaaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatcccgcgaacccttctgaaaggagggggtgccttcgggagcgcggagacaggtggtgcatggctgtcgtcagctcgtgtcgtgagatgttgggttaagtcccgcaacgagcgcaaccctcgtccttagttgccatcattgagttgggcactctggggagactgccggggacaactcggaggaaggtggggatgacgtcaagtcatcatgccccttacgttctgggctacacacgtactacaatgcttcggacagagggcagcgagcctgcgagggtgagctaatcccataaaccgaggcacagttcagattgcaggctgcaactcgcctgcatgaaggaggaatcgctagtaatcgcaggtcagcatactgcggtgaatacgttcccgggccttgtacacaccgcccgtcacaccatgggagttggccacgcccgaagccgttactccaacctttcggggaggaggacgtcgaaggcagggctgatgactggggtgaagtcgtaacaaggtagccgtaccggaaggtgtggctggatcacctcctttaaggg

SEQ ID NO: 4192 - DNA, 1541 bp, Halomonas aestuarii
  ref <308>: DATABASE ACCESSION NUMBER: NCBI ACCESSION: NZ_CP018139.1
  ref <309>: DATABASE ENTRY DATE: 2019-04-01
  ref <313>: RELEVANT RESIDUES IN SEQ ID NO: (1)..(1541)
aaactgaagagtttgatcatggctcagattgaacgctggcggcaggcctaacacatgcaagtcgagcggaaacgatcctagcttgctaggaggcgtcgagcggcggacgggtgagtaatgcataggaatctgcccgatagtgggggataacctggggaaactcaggctaataccgcatacgtcctacgggagaaagcaggggatcttcggaccttgcgctatcggatgagcctatgtcggattagcttgttggtgaggtaatggctcaccaaggcgacgatccgtagctggtctgagaggatgatcagccacatcgggactgagacacggcccgaactcctacgggaggcagcagtggggaatattggacaatgggcgaaagcctgatccagccatgccgcgtgtgtgaagaaggctttcgggttgtaaagcactttcagtgaggaagaaagccttggggctaatacccccaagggacgacatcactcacagaagaagcaccggctaactccgtgccagcagccgcggtaatacggagggtgcgagcgttaatcggaattactgggcgtaaagcgcgcgtaggcggcttgataagccggttgtgaaagccccgggctcaacctgggaacggcatccggaactgtcaggctagagtgcaggagaggaaggtagaattcccggtgtagcggtgaaatgcgtagagatcgggaggaataccagtggcgaaggcggccttctggactgacactgacgctgaggtgcgaaagcgtgggtagcaaacaggattagataccctggtagtccacgccgtaaacgatgtcgactagccgttggggtcctagagacctttgtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatcgtgcgaactttccagagatggattggtgccttcgggagcgcacagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtagggctacacacgtgctacaatggccggtacaatgggttgcaaagccgcgaggtggagctaatcccacaaagccggtctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcctaacttcggagggcgatcaccacggtgtggttcatgactggggtgaagtcgtaacaaggtagccgtaggggaacctgcggctggatcacctccttaaac

SEQ ID NO: 4193 - DNA, 1540 bp, Halomonas alkaliphila
  ref <308>: DATABASE ACCESSION NUMBER: NCBI ACCESSION: NZ_CP024811.1
  ref <309>: DATABASE ENTRY DATE: 2019-04-01
  ref <313>: RELEVANT RESIDUES IN SEQ ID NO: (1)..(1540)
ttaaactgaagagtttgatcatggctcagattgaacgctggcggcaggcctaacacatgcaagtcgagcggtaacaggggtagcttgctacccgctgacgagcggcggacgggtgagtaatgcataggaatctgcccgatagtgggggataacctggggaaacccaggctaataccgcatacgtcctacgggagaaagggggctccggctcccgctattggatgagcctatgtcggattagctagttggtgaggtaatggctcaccaaggcaacgatccgtagctggtctgagaggatgatcagccacatcgggactgagacacggcccgaactcctacgggaggcagcagtggggaatattggacaatgggcgaaagcctgatccagccatgccgcgtgtgtgaagaaggccctcgggttgtaaagcactttcagcgaggaagaacgcctagtggttaatacccattaggaaagacatcactcgcagaagaagcaccggctaactccgtgccagcagccgcggtaatacggagggtgcaagcgttaatcggaattactgggcgtaaagcgcgcgtaggtggcttgataagccggttgtgaaagccccgggctcaacctgggaacggcatccggaactgtcaagctagagtgcaggagaggaaggtagaattcccggtgtagcggtgaaatgcgtagagatcgggaggaataccagtggcgaaggcggccttctggactgacactgacactgaggtgcgaaagcgtgggtagcaaacaggattagataccctggtagtccacgccgtaaacgatgtcgaccagccgttgggtgcctagcgcactttgtggcgaagttaacgcgataagtcgaccgcctggggagtacggccgcaaggttaaaactcaaatgaattgacgggggcccgcacaagcggtggagcatgtggtttaattcgatgcaacgcgaagaaccttacctactcttgacatcctgcgaacttgtgagagatcacttggtgccttcgggaacgcagagacaggtgctgcatggctgtcgtcagctcgtgttgtgaaatgttgggttaagtcccgtaacgagcgcaacccttgtccttatttgccagcgggtaatgccgggaactctaaggagactgccggtgacaaaccggaggaaggtggggacgacgtcaagtcatcatggcccttacgagtagggctacacacgtgctacaatggccggtacaaagggttgcgagctcgcgagagtcagctaatcccgaaaagccggtctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggaaagcgatcaccacggtgtggttcatgactggggtgaagtcgtaacaaggtagccgtaggggaacctgcggctggatcacctccttaaac

SEQ ID NO: 4194 - DNA, 1540 bp, Halomonas nitroreducens
  ref <308>: DATABASE ACCESSION NUMBER: NCBI ACCESSION: NZ_RXNS01000041.1
  ref <309>: DATABASE ENTRY DATE: 2019-04-01
  ref <313>: RELEVANT RESIDUES IN SEQ ID NO: (1)..(1540)
aaactgaagagtttgatcatggctcagattgaacgctggcggcaggcctaacacatgcaagtcgagcggaaacgatggaagcttgcttccaggcgtcgagcggcggacgggtgagtaatgcataggaatctgcccggtagtgggggataacctgaggaaactcaggctaataccgcatacgccctacgggggaaagcaggggatcttcggaccttgcgctatcggatgagcctatgtcggattagcttgttggtgaggtaatggctcaccaaggccgcgatccgtagctggtctgagaggatgatcagccacatcgggactgagacacggcccgaactcctacgggaggcagcagtggggaatattggacaatgggcgaaagcctgatccagccatgccgcgtgtgtgaagaaggccttcgggttgtaaagcactttcagtgaggaagaacgcctctgggctaataccccagagggaagacatcactcacagaagaagcaccggctaactccgtgccagcagccgcggtaatacggagggtgcgagcgttaatcggaattactgggcgtaaagcgcgcgtaggcggcgtgataagccggttgtgaaagccccgggctcaacctgggaacggcatccggaactgtcaggctagagtgcaggagaggaaggtagaattcccggtgtagcggtgaaatgcgtagagatcgggaggaataccagtggcgaaggcggccttctggactgacactgacgctgaggtgcgaaagcgtgggtagcaaacaggattagataccctggtagtccacgccgtaaacgatgtcgactagccgttggggtccttgagacctttgtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatcgtgcgaactttccagagatggattggtgccttcgggaacgcacagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtagggctacacacgtgctacaatggtcggtacaatgggttgcaaagccgcgaggtggagctaatcccataaagccggtctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcctaacttcggagggcgatcaccacggtgtggttcatgactggggtgaagtcgtaacaaggtagccgtaggggaacctgcggctggatcacctccttaat

SEQ ID NO: 4195 - DNA, 1541 bp, Halomonas sp. 362.1
  ref <308>: DATABASE ACCESSION NUMBER: NCBI ACCESSION: NZ_QWBW01000001.1
  ref <309>: DATABASE ENTRY DATE: 2019-04-01
  ref <313>: RELEVANT RESIDUES IN SEQ ID NO: (1)..(1541)
caactgaagagtttgatcatggctcagattgaacgctggcggcaggcttaacacatgcaagtcgagcggtaacgggtccagcttgctggatgcygacgagcggcggacgggtgagtaatgcataggaatctgcccggtagtgggggataacctggggaaacccaggctaataccgcatacgtcctacgggagaaagcaggggatcttcggaccttgcgctatcggatgagcctatgtcggattagctggttggtgaggtaacggctcaccaaggcgacgatccgtagctggtctgagaggatgatcagccacactgggactgagacacggcccagactcctacgggaggcagcagtggggaatattggacaatgggcgcaagcctgatccagccatgccgcgtgtgtgaagaaggctttcgggttgtaaagcactttcagcggggaagaaagcgtgccggttaatacccggtacggacgacatcacccgcagaagaagcaccggctaactccgtgccagcagccgcggtaatacggagggtgcaagcgttaatcggaattactgggcgtaaagcgcgcgtaggcggctaagtaagccggttgtgaaagccccgggctcaacctgggaatggcatccggaactgtttagctagagtgcaggagaggaaggtagaattcccggtgtagcggtgaaatgcgtagagatcgggaggaataccagtggcgaaggcggccttctggactgacactgacgctgaggtgcgaaagcgtgggtagcaaacaggattagataccctggtagtccacgccgtaaacgatgtcgactagccgttgggtcccttgaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatcctcggaatccgccggagacggyggagtgccttcgggagccgagagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtagggctacacacgtgctacaatggccggtacaaagggttgcaatcccgcgagggggagccaatctcggaaagccggtctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcctaacttcggagggcgatcaccacggtgtggttcatgactggggtgaagtcgtaacaaggtagccgtaggggaacctgcggctggatcacctccttaacc

SEQ ID NO: 4196 - DNA, 1347 bp, Halomonas sp. ALS9
  ref <308>: DATABASE ACCESSION NUMBER: NCBI ACCESSION: NZ_LXRG01000159.1
  ref <309>: DATABASE ENTRY DATE: 2019-04-01
  ref <313>: RELEVANT RESIDUES IN SEQ ID NO: (1)..(1347)
gagaaagggggcttcggctcccgctattggatgagcctatgtcggattagctagttggtgaggtaaaggctcaccaaggcaacgatccgtagctggtctgagaggatgatcagccacatcgggactgagacacggcccgaactcctacgggaggcagcagtggggaatattggacaatgggggcaaccctgatccagccatgccgcgtgtgtgaagaaggccttcgggttgtaaagcactttcagcgaggaagaacgcctagtggttaatacccattaggaaagacatcactcgcagaagaagcaccggctaactccgtgccagcagccgcggtaatacggagggtgcaagcgttaatcggaattactgggcgtaaagcgcgcgtaggtggcttgataagccggttgtgaaagccccgggctcaacctgggaacggcatccggaactgtcaggctagagtgcaggagaggaaggtagaattcccggtgtagcggtgaaatgcgtagagatcgggaggaataccagtggcgaaggcggccttctggactgacactgacactgaggtgcgaaagcgtgggtagcaaacaggattagataccctggtagtccacgccgtaaacgatgtcgaccagccgttgggtgcctagcgcactttgtggcgaagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatctacagaagccggaagagattctggtgtgccttcgggaactgtaagacaggtgctgcatggctgtcgtcagctcgtgttgtgaaatgttgggttaagtcccgtaacgagcgcaacccttgtccttatttgccagcgagtaatgtcgggaactctaaggagactgccggtgacaaaccggaggaaggtggggacgacgtcaagtcatcatggcccttacgggtagggctacacacgtgctacaatggccggtacaaagggctgcgagctcgcgagagtcagcgaatcccttaaagccggtctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcctaacgcaagagggcgatcaccacggtgtggttcatgactggggtgaagtcgtaacaaggtagccgtaggggaacctgcggctggatcacctccttaaac

SEQ ID NO: 4197 - DNA, 1537 bp, Halomonas sp. DSM 19434
  ref <308>: DATABASE ACCESSION NUMBER: NCBI ACCESSION: NZ_RZHG01000008.1
  ref <309>: DATABASE ENTRY DATE: 2019-04-01
  ref <313>: RELEVANT RESIDUES IN SEQ ID NO: (1)..(1537)
taaactgaagagtttgatcatggctcagattgaacgctggcggcaggcctaacacatgcaagtcgagcggtagcagatctagcttgctagatgctgacgagcggcggacgggtgagtaatgcataggaatctgcccggtagtgggggataacctggggaaacccaggctaataccgcatacgtcctacgggagaaagggggcttcggctcccgctattggatgagcctatgtcggattagctagttggtgaggtaatggctcaccaaggcaacgatccgtagctggtctgagaggatgatcagccacatcgggactgagacacggcccgaactcctacgggaggcagcagtggggaatattggacaatgggggcaaccctgatccagccatgccgcgtgtgtgaagaaggccttcgggttgtaaagcactttcagcgaggaagaacgcctggtggttaatacccaccaggaaagacatcactcgcagaagaagcaccggctaactccgtgccagcagccgcggtaatacggagggtgcaagcgttaatcggaattactgggcgtaaagcgcgcgtaggtggcttgataagccggttgtgaaagccccgggctcaacctgggaacggcatccggaactgtcaagctagagtgcaggagaggaaggtagaattcccggtgtagcggtgaaatgcgtagagatcgggaggaataccagtggcgaaggcggccttctggactgacactgacactgaggtgcgaaagcgtgggtagcaaacaggattagataccctggtagtccacgccgtaaacgatgtcgaccagccgttgggtgcctagcgcactttgtggcgaagttaacgcgataagtcgaccgcctggggagtacggccgcaaggttaaaactcaaatgaattgacgggggcccgcacaagcggtggagcatgtggtttaattcgatgcaacgcgaagaaccttacctactcttgacatcctgcgaatttggtagagataccttagtgccttcgggaacgcagagacaggtgctgcatggctgtcgtcagctcgtgttgtgaaatgttgggttaagtcccgtaacgagcgcaacccttgtccttatttgccagcgggtaatgccgggaactctaaggagactgccggtgacaaaccggaggaaggtggggacgacgtcaagtcatcatggcccttacgagtagggctacacacgtgctacaatggccggtacaaagggttgcgagctcgcgagagtcagctaatcccgaaaagccggtctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcctaacgcaagagggcgatcaccacggtgtggttcatgactggggtgaagtcgtaacaaggtagccgtaggggaacctgcggctggatcacctccttaaac

SEQ ID NO: 4198 - DNA, 1538 bp, Halomonas sp. JCM 18142
  ref <308>: DATABASE ACCESSION NUMBER: NCBI ACCESSION: NZ_RZHF01000016.1
  ref <309>: DATABASE ENTRY DATE: 2019-04-01
  ref <313>: RELEVANT RESIDUES IN SEQ ID NO: (1)..(1538)
ttaaactgaagagtttgatcatggctcagattgaacgctggcggcaggcttaacacatgcaagtcgagcggtaacaggtctagcttgctagacgctgacgagcggcggacgggtgagtaatgcataggaatctgcccgatagtgggggataacctggggaaacccaggctaataccgcatacgtcctacgggagaaagggggctccggctcccgctatcggatgagcctatgtcggattagctagttggtggggtaatggcccaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggccttagggttgtaaagcactttcagcgaggaagaacgcctggcggttaatacccgccaggaaagacatcactcgcagaagaagcaccggctaactccgtgccagcagccgcggtaatacggagggtgcaagcgttaatcggaattactgggcgtaaagcgcgcgtaggtggcttgataagccggttgtgaaagccccgggctcaacctgggaacggcatccggaactgtcaagctagagtacaggagaggaaggtagaattcccggtgtagcggtgaaatgcgtagagatcgggaggaataccagtggcgaaggcggccttctggactgatactgacactgaggtgcgaaagcgtgggtagcaaacaggattagataccctggtagtccacgccgtaaacgatgtcgaccagccgttgggtgcctagcgcactttgtggcgaagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatctacagaacctggaagagattccggggtgccttcgggaactgtaagacaggtgctgcatggctgtcgtcagctcgtgttgtgaaatgttgggttaagtcccgtaacgagcgcaacccttgtccttatttgccagcacgtaatggtgggaactctaaggagactgccggtgacaaaccggaggaaggtggggacgacgtcaagtcatcatggcccttacgggtagggctacacacgtgctacaatggccggtacaaagggttgcgaactcgcgagagtaagccaatcccagaaagccggtctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcctaacgcaagagggcgatcaccacggtgtggttcatgactggggtgaagtcgtaacaaggtagccgtaggggaacctgcggctggatcacctccttaaac

SEQ ID NO: 4199 - DNA, 1541 bp, Halomonas sp. JS92-SW72
  ref <308>: DATABASE ACCESSION NUMBER: NCBI ACCESSION: NZ_CP032147.1
  ref <309>: DATABASE ENTRY DATE: 2019-04-01
  ref <313>: RELEVANT RESIDUES IN SEQ ID NO: (1)..(1541)
aaactgaagagtttgatcatggctcagattgaacgctggcggcaggcctaacacatgcaagtcgagcggcagcacgggaagcttgcttcctggtggcgagcggcggacgggtgagtaatgcatagaaatctgcccggtagtgggggataacctggggaaacccaggctaataccgcatacgtcctacgggagaaagcaggggctcttcggaccttgcgctatcggatgagtctatgtcggattagcttgttggtgaggtaatggctcaccaaggcgacgatccgtagctggtctgagaggatgatcagccacatcgggactgagacacggcccgaactcctacgggaggcagcagtggggaatattggacaatgggcgaaagcctgatccagccatgccgcgtgtgtgaagaaggccttcgggttgtaaagcactttcagtggggaagaaagccttggggctaataccctcgaggaaggacatcacccacagaagaagcaccggctaactccgtgccagcagccgcggtaatacggagggtgcgagcgttaatcggaattactgggcgtaaagcgcgcgtaggcggtctgataagccggttgtgaaagccccgggctcaacctgggaacggcatccggaactgtcaggctagagtgcaggagaggaaggtagaattcccggtgtagcggtgaaatgcgtagagatcgggaggaataccagtggcgaaggcggccttctggactgacactgacgctgaggtgcgaaagcgtgggtagcaaacaggattagataccctggtagtccacgccgtaaacgatgtcgactagccgttgggctccttgagagctttgtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatcgtgcgaactttccagagatggattggtgccttcgggaacgcacagacaggtgctgcatggctgtcgtcagctcgtgttgtgaaatgttgggttaagtcccgtaacgagcgcaacccttgtccttatttgccagcgcgtaatggcgggaactctaaggagactgccggtgacaaaccggaggaaggtggggacgacgtcaagtcatcatggcccttacgggtagggctacacacgtgctacaatggccggtacaaagggttgcgaagccgcgaggtggagctaatcccgaaaagctggtctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtgggtagcctaacttaggagggcgatcaccacggtgtggttcatgactggggggaagtcggaacaaggtagccgtaggggaacctgcggctggatcacctccttatc

SEQ ID NO: 4200 - DNA, 1538 bp, Halomonas sp. KX33721
  ref <308>: DATABASE ACCESSION NUMBER: NCBI ACCESSION: NZ_LVIA01000080.1
  ref <309>: DATABASE ENTRY DATE: 2019-04-01
  ref <313>: RELEVANT RESIDUES IN SEQ ID NO: (1)..(1538)
ttaaactgaagagtttgatcatggctcagattgaacgctggcggcaggcctaacacatgcaagtcgagcggtaacagatccagcttgctggatgctgacgagcggcggacgggtgagtaatgcataggaatctgcccgatagtgggggataacctggggaaacccaggctaataccgcatacgtcctacgggagaaagggggctccggctcccgctatgggatgagcctatgtcggattagctagttggtgaggtaacggctcaccaaggccacgatccgtagctggtctgagaggatgatcagccacatcgggactgagacacggcccgaactcctacgggaggcagcagtggggaatattggacaatgggggaaaccctgatccagccatgccgcgtgtgtgaagaaggccctcgggttgtaaagcactttcagcgaggaagaacgcctagcggttaatacccgctaggaaagacatcactcgcagaagaagcaccggctaactccgtgccagcagccgcggtaatacggagggtgcaagcgttaatcggaattactgggcgtaaagcgcgcgtaggtggcttgataagccggttgtgaaagccccgggctcaacctgggaacggcatccggaactgtcaagctagagtgcaggagaggaaggtagaattcccggtgtagcggtgaaatgcgtagagatcgggaggaataccagtggcgaaggcggccttctggactgacactgacactgaggtgcgaaagcgtgggtagcaaacaggattagataccctggtagtccacgccgtaaacgatgtcgaccagccgttgggtgcctagcgcactttgtggcgaagttaacgcgataagtcgaccgcctggggagtacggccgcaaggttaaaactcaaatgaattgacgggggcccgcacaagcggtggagcatgtggtttaattcgatgcaacgcgaagaaccttacctactcttgacatcctgcgaatttggtagagataccttagtgccttcgggaacgcagagacaggtgctgcatggctgtcgtcagctcgtgttgtgaaatgttgggttaagtcccgtaacgagcgcaacccttgtccttatttgccagcgcgtaatggcgggaactctaaggagactgccggtgacaaaccggaggaaggtggggacgacgtcaagtcatcatggcccttacgagtagggctacacacgtgctacaatggtcggtacaaagggttgccaactcgcgagagtgagccaatcccgaaaagccgatctcagtccggatcggagtctgcaactcgactccgtgaagtcggaatcgctagtaatcgtggatcagaatgccacggtgaatacgttcccgggccttgtacacaccgcccgtcacaccatgggagtggactgcaccagaagtggttagcctaacgcaagagggcgatcaccacggtgtggttcatgactggggtgaagtcgtaacaaggtagccgtaggggaacctgcggctggatcacctccttaaac

SEQ ID NO: 4201 - DNA, 1536 bp, Halomonas sp. MC
  ref <308>: DATABASE ACCESSION NUMBER: NCBI ACCESSION: NZ_RZHE01000014.1
  ref <309>: DATABASE ENTRY DATE: 2019-04-01
  ref <313>: RELEVANT RESIDUES IN SEQ ID NO: (1)..(1536)
aaactgaagagtttgatcatggctcagattgaacgctggcggcaggcttaacacatgcaagtcgagcggtaacaggtctagcttgctagacgctgacgagcggcggacgggtgagtaatgcataggaatctgcccggtagtgggggataacctggggaaacccaggctaataccgcatacgtcctacgggagaaagggggcttcggctcccgctattggatgagcctatgtcggattagctagttggtgaggtaatggctcaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggccttcgggttgtaaagcactttcagcgaggaagaacgcctggtggttaatacccatcaggaaagacatcactcgcagaagaagcaccggctaactccgtgccagcagccgcggtaatacggagggtgcaagcgttaatcggaattactgggcgtaaagcgcgcgtaggtggcttgataagccggttgtgaaagccccgggctcaacctgggaacggcatccggaactgtcaagctagagtgcaggagaggaaggtagaattcccggtgtagcggtgaaatgcgtagagatcgggaggaataccagtggcgaaggcggccttctggactgacactgacactgaggtgcgaaagcgtgggtagcaaacaggattagataccctggtagtccacgccgtaaacgatgtcgaccagccgttgggtgcctagcgcactttgtggcgaagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatcctgcgaacttggtagagataccttggtgccttcgggaacgcagagacaggtgctgcatggctgtcgtcagctcgtgttgtgaaatgttgggttaagtcccgtaacgagcgcaacccttgtccttatttgccagcacgtaatggtgggaactctaaggagactgccggtgacaaaccggaggaaggtggggacgacgtcaagtcatcatggcccttacgggtagggctacacacgtgctacaatggccggtacaaagggttgcgaacttgcgagagtaagccaatcccagaaagccggtctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcctaacgcaagagggcgatcaccacggtgtggttcatgactggggtgaagtcgtaacaaggtagccgtaggggaacctgcggctggatcacctccttaaac

SEQ ID NO: 4202 - DNA, 1536 bp, Halomonas sp. RC; identical to SEQ ID NO: 4201
  ref <308>: DATABASE ACCESSION NUMBER: NCBI ACCESSION: NZ_RZHD01000011.1
  ref <309>: DATABASE ENTRY DATE: 2019-04-01
  ref <313>: RELEVANT RESIDUES IN SEQ ID NO: (1)..(1536)

SEQ ID NO: 4203 - DNA, 1033 bp, Halomonas sp. YLB-10
  ref <308>: DATABASE ACCESSION NUMBER: NCBI ACCESSION: NZ_RRCU01000024.1
  ref <309>: DATABASE ENTRY DATE: 2019-04-01
  ref <313>: RELEVANT RESIDUES IN SEQ ID NO: (1)..(1033)
aaactgaagagtttgatcatggctcagattgaacgctggcggcaggcctaacacatgcaagtcgagcggaaacgatcctagcttgctaggaggcgtcgagcggcggacgggtgagtaatgcataggaatctgcccggtagtgggggataacctggggaaacccaggctaataccgcatacgccctacgggggaaagcaggggatcttcggaccttgcgctatcggatgagcctatgtcggattagctagttggtgaggtaacggctcaccaaggctgcgatccgtagctggtctgagaggatgatcagccacatcgggactgagacacggcccgaactcctacgggaggcagcagtggggaatattggacaatgggcgaaagcctgatccagccatgccgcgtgtgtgaagaaggccttcgggttgtaaagcactttcagtgaggaagaaagccttgaggttaataccctcgagggaggacatcactcacagaagaagcaccggctaactccgtgccagcagccgcggtaatacggagggtgcgagcgttaatcggaattactgggcgtaaagcgcgcgtaggcggcttgataagccggttgtgaaagccccgggctcaacctgggaacggcatccggaactgtcaggctagagtgcaggagaggaaggtagaattcccggtgtagcggtgaaatgcgtagagatcgggaggaataccagtggcgaaggcggccttctggactgacactgacgctgaggtgcgaaagcgtgggtagcaaacaggattagataccctggtagtccacgccgtaaacgatgtcgactagccgttgggctccttgagagctttgtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatcgagagaactttccagagatggattggtgccttcggga

SEQ ID NO: 4204 - DNA, 1540 bp, Halomonas venusta
  ref <308>: DATABASE ACCESSION NUMBER: NCBI ACCESSION: NZ_CP034367.1
  ref <309>: DATABASE ENTRY DATE: 2019-04-01
  ref <313>: RELEVANT RESIDUES IN SEQ ID NO: (1)..(1540)
ttaaactgaagagtttgatcatggctcagattgaacgctggcggcaggcctaacacatgcaagtcgagcggtaacaggggtagcttgctacccgctgacgagcggcggacgggtgagtaatgcataggaatctgcccgatagtgggggataacctggggaaacccaggctaataccgcatacgtcctacgggagaaagggggctccggctcccgctattggatgagcctatgtcggattagctagttggtgaggtaaaggctcaccaaggcgacgatccgtagctggtctgagaggatgatcagccacatcgggactgagacacggcccgaactcctacgggaggcagcagtggggaatattggacaatgggcgaaagcctgatccagccatgccgcgtgtgtgaagaaggccctcgggttgtaaagcactttcagcgaggaagaacgcctagtggttaatacccattaggaaagacatcactcgcagaagaagcaccggctaactccgtgccagcagccgcggtaatacggagggtgcaagcgttaatcggaattactgggcgtaaagcgcgcgtaggtggcttgataagccggttgtgaaagccccgggctcaacctgggaacggcatccggaactgtcaagctagagtgcaggagaggaaggtagaattcccggtgtagcggtgaaatgcgtagagatcgggaggaataccagtggcgaaggcggccttctggactgacactgacactgaggtgcgaaagcgtgggtagcaaacaggattagataccctggtagtccacgccgtaaacgatgtcgaccagccgttgggtgcctagcgcactttgtggcgaagttaacgcgataagtcgaccgcctggggagtacggccgcaaggttaaaactcaaatgaattgacgggggcccgcacaagcggtggagcatgtggtttaattcgatgcaacgcgaagaaccttacctactcttgacatcctgcgaacttgtgagagatcacttggtgccttcgggaacgcagagacaggtgctgcatggctgtcgtcagctcgtgttgtgaaatgttgggttaagtcccgtaacgagcgcaacccttgtccttatttgccagcgcgtaatggcgggaactctaaggagactgccggtgacaaaccggaggaaggtggggacgacgtcaagtcatcatggcccttacgagtagggctacacacgtgctacaatggccggtacaaagggttgcgagctcgcgagagtcagctaatcccgaaaagccggtctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggaaagcgatcaccacggtgtggttcatgactggggtgaagtcgtaacaaggtagccgtaggggaacctgcggctggatcacctccttaaac

SEQ ID NO: 4205 - DNA, 1544 bp, Halonatronum saccharophilum
  ref <308>: DATABASE ACCESSION NUMBER: NCBI ACCESSION: NZ_KI912095.1
  ref <309>: DATABASE ENTRY DATE: 2019-04-01
  ref <313>: RELEVANT RESIDUES IN SEQ ID NO: (1)..(1544)
tttaatggagagtttgatcctggctcaggacgaacgctggcggcgtgcttaacacatgcaagtcgagcgagaaagctacttcggtagtgagtaaagcggcggacgggtgagtaacgcgtgggttatctacctttaagtttgggataacttctcgaaagggaagctaataccggataaactccttttggagcaaaggcggcttttgctgtcgcttaaagatgagcctgcgtcccattagctagttggtgagataaaagctcaccaaggcaacaatgggtagccgacctgagagggtgatcggccacactgggactgagacacggcccagactcctacgggaggctgcagtggggaatcttccgcaatggacgaaagtctgacggagcaacgccgcgtgaatgatgaaggccttcgggtcgtaaagttctgtccttagggaagaacactttaagtgctaatatcacttgaagctgacggtacctttggaggaagccctggctaactacgtgccagcagccgcggtaatacgtagagggcgagcgttgtccggaatcattgggtgtaaagggtacgcaggcggtttggtaagtcagaggtgaaatccaccagctcaactggtgaactgcctttgatactgccaaacttgaggttaagagaagaaagcggaattcctagtgtagtggtgaaatacgtagatattaggaagaataccgatggcgaaagcagctttctaacttatacctgacgctgaggtacgaaagctagggtagcaaacgggattagataccccggtagtcctagccgtaaacgatggatactaggtgttggaggttcgactccttcggtgccgcagttaacgcattaagtatcccacctggggattacgaccgcaaggttgaaactcaaaggaattgacgggggcccgcacaagcggtggagcatgtggtttaattcgaagcaacgcgaagaaccttaccaaaacttgacatccctctaactacttcttaatcgaaggttttctctttgagaatagaggagacaggtggtgcatggctgtcgtcagctcgtgtcgtgagatgttgggttaagtcccgtaacgagcgcaacccctatccttagttgccagcgagtaatgtcggggactctagggagactgccgcggaaaaacgcggaggaaggtggggatgacgtcaagtcatcatgccccttatgttttgggctacacacgtgctacaatggtctatacagagggtggctacatcgcgagatgatgctaatctctaaagtagatctcagttcggattgcaggctgcaactcgcctgcatgaagctggaatcgctagtaatcgcggatcagaatgtcgcggtgaatacgttcccgggccttgtacacaccgcccgtcacaccacccgagtcgggggcaccagaagtcatcggcctaacgtaagaaggagatgccgaaggtgtgcctgataaggggggtgaagtcgtaacaaggtagccgtaccggaaggtgcggctggatcacctcctttctaaggag

SEQ ID NO: 4206 - DNA, 1493 bp, Halothece sp. PCC 7418
  ref <308>: DATABASE ACCESSION NUMBER: NCBI ACCESSION: NC_019779.1
  ref <309>: DATABASE ENTRY DATE: 2019-04-01
  ref <313>: RELEVANT RESIDUES IN SEQ ID NO: (1)..(1493)
tcaacatggagagtttgatcctggctcaggatgaacgctggcggcgtgcttaacacatgcaagtcgaacgaagccctcgggcttagtggcggacgggtgagtaacgcgtgagaatctaccttcaggatggggacaaccgttggaaacgacggctaatccccaataggccgagaggtgaaacaggtttctgcctgaagaggagctcgcgtccgattagttagttggtggggtaaaagcgtaccaaggcagcgatcggtagctggtctgagaggatgagcagccacactgggactgagacacggcccagactcctacgggaggcagcagtggggaattttccgcaatgggcgaaagcctgacggagcaacgccgcgtgtgggaagaaggctcttgggctgtcaaccacttttctcagggaagaagtcctgacggtacctgaggaatcagcctcggctaactccgtgccagcagccgcggtaatacggaggaggcaagcgttatccggaattattgggcgtaaagcgtccgcagggggcgcatcaagtctgctgttaaaggtcggagctcaactccggtagagcagtggaaactggtgcgctagagggcgacaggggtagagggaattcccagtgtagcggtgaaatgcgtagagattgggaagaacaccggtggcgaaagcgctctactgggtcgcacctgaccctcagggacgaaagctaaggtagcgaaagggattagatacccctgtagtcttagccgtaaacgatggatactaggcgtggtttgtatcgacccaagccgtgccgaagctaacgcgttaagtatcccgcctggggagtacgcacgcaagtgtgcaactcaaaggaattgacgggggcccgcacaagcggtggaggatgtggtttaattcgatgcaacgcgaagaaccttaccagggcttgacatcccgcgaagtctggggaaactcagacgtgcctacgggaacgcggagacaggtggtgcatggctgtcgtcagctcgtgtcgtgagatgttgggttaagtcccgcaacgagcgcaaccctcgtccttagttgccagcattaggttgggcactctagggagactgccggtgacaaaccggaggaaggtgaggatgacgtcaagtcagcatgccccttatgctctgggcaacacacgtcctacaatggtcgggacaaaggggagcgagctcgcgagagtaagcgaatcccagcaaactcggcctcagttcagatagcaggctgcaactcgcctgcttgaaggaggaatcgctagtaatcgcaggtcagaatactgcggtgaattcgttcccgggccttgtacacaccgcccgtcacaccatggaagctggccaagcccgaagtcgttaccctaaccggtttggaggggggcgccgaaggctgggctggtgactggggtgaagtcgtaacaaggtagccgtaccggaaggtgtggctggatcacctccttaat

SEQ ID NO: 4207 - DNA, 1561 bp, Halothermothrix orenii
  ref <308>: DATABASE ACCESSION NUMBER: NCBI ACCESSION: NC_011899.1
  ref <309>: DATABASE ENTRY DATE: 2019-04-01
  ref <313>: RELEVANT RESIDUES IN SEQ ID NO: (1)..(1561)
tttacacggagagtttgatcctggctcaggacgaacgctggcggcgtgcttaacacatgcaagtcgaacggcccgccccgactgaatccttcgggatgacgacgggatccgggcagtggcggacgggtgagtaacgcgtggagaacctgtctttcagtccgggataacctggcgaaagccgggctaatcccggatagactgtcggatgagcattcaactgacaggaaaggcggtttatccgttgctgagagagggctccgcgtcggattagctagttggtgaggtaacagctcaccaaggcgacgatccgtagctggtctgagaggacgatcagccacactgggactgagacacggcccagactcctacgggaggcagcagtggggaatcttccgcaatgggcgaaagcctgacggagcaacgccgcgtgggtgacgaaggccttcgggtcgtaaagccctgtcctcagggaagaacccttacaggaggaaatgcctgtaagctgacggtacctgaggaggaagccctggctaactacgtgccagcagccgcggtaatacgtagagggcgagcgttgtccggaattactgggcgtaaagggtgcgtaggcgggtaggcaagtcaaatgtgaaatccgtcggctcaaccggcgaatagcatttgaaactgcctatcttgagtgcaggagagggaagcggaattcctggtgtagcggtgaaatgcgtagatatcaggaagaacaccagtggcgaaggcggcttcctggcctgcaactgacgctgaggcacgaaagctgggggagcgaacgggattagataccccggtagtcccagccgtaaacgatggacactaggtgttggaggttcgattccttcagtgccggagttaacgcgataagtgtcccgcctggggagtacggtcgcaagattgaaactcaaaggaattgacgggggcccgcacaagcggtggagcatgtggtttaattcgatgcaacgcgaagaaccttaccgaggcttgacatcccgtgactacctgtgagagcagggtttggctctttgagccacacggagacaggtggtgcatggctgtcgtcagctcgtgtcgtgagatgttgggttaagtcccgcaacgagcgcaacccctgttcctagttgccagcacgtcaaggtggggactctagggagactgccggtgaaagccggaggaaggtggggatgacgtcaagtcctcatgccctttatgcctcgggctacacacgtgctacaatggccggtacagagggcggcgaacccgcaagggggagctaatctcaaaaaaccggtcccagttcggattgcaggctgcaactcgcctgcatgaagctggaatcgctagtaatcgcaggtcagcatactgcggtgaatacgttcccgggccttgtacacaccgcccgtcacaccacccgagtcggatgcaccagaagtcacctgcgggtgccgaaggtgtgtctggtaaggggggtgaagtcgtaacaaggtagccgtacgggaacgtgcggctggatcacctcctttctaaggag

SEQ ID NO: 4208 - DNA, 1489 bp, Hansschlegelia zhihuaiae
  ref <308>: DATABASE ACCESSION NUMBER: NCBI ACCESSION: NZ_RYFI01000017.1
  ref <309>: DATABASE ENTRY DATE: 2019-04-01
  ref <313>: RELEVANT RESIDUES IN SEQ ID NO: (1)..(1489)
tcaacctgagagtttgatcctggctcagaacgaacgctggcggcaggcttaacacatgcaagtcgagcgccccgcaaggggagcggcagacgggtgagtaacgcgtggggatgtgcctggtggtacggaacaactcagggaaacttgagctaataccgtataagcccttcgggggaaagatttatcgccaccagatcaacccgcgttggattagctagttggtgaggtaacggctcaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctctttcactggggaagataatgacggtacccagagaagaagccccggctaacttcgtgccagcagccgcggtaatacgaagggggctagcgttgttcggaatcactgggcgtaaagcgcacgtaggcggacacttaagtcagaggtgaaatcccaaggctcaaccttggaactgcctttgatactgggtgtcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacaggattagataccctggtagtccacgccgtaaacgatggaagctagccgttggccagcatgctggtcagtggcgcagctaacgctttaagcttcccgcctggggagtacggtcgcaagattaaaactcaaaggaattgacgggggcccgcacaagcggtggagcatgtggtttaattcgaagcaacgcgcagaaccttaccagcctttgacatcctgtgttacccaaagagatttggggtccacttcggtggcgcagagacaggtgctgcatggctgtcgtcagctcgtgtcgtgagatgttgggttaagtcccgcaacgagcgcaaccctcgcccctagttgccagcattaagttgggcactctagggggactgccggtgataagccgagaggaaggtggggatgacgtcaagtcctcatggcccttacgggctgggctacacacgtgctacaatggcggtgacaatgggcagcgaaggggtgacccggagctaatctccaaaaaccgtctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggcgttgcgctaacccgcaagggaggcaggcgaccacggtagggtcagcgactggggtgaagtcgtaacaaggtagccgtaggggaacctgcggctggatcacctcctttctaag

SEQ ID NO: 4209 - DNA, 1490 bp, Hapalosiphon sp. MRB220
  ref <308>: DATABASE ACCESSION NUMBER: NCBI ACCESSION: NZ_LIRN01000019.1
  ref <309>: DATABASE ENTRY DATE: 2019-04-01
  ref <313>: RELEVANT RESIDUES IN SEQ ID NO: (1)..(1490)
aaaacggagagtttgatcctggctcaggatgaacgctggcggtatgcttaacacatgcaagtcgaacggtctcttcggagatagtggcggacgggtgagtaacgcgtgagaatctggctctaggtctgggacaaccactggaaacggtggctaataccggatgtgcctgtgggtgaaaggttaactgcctggagatgagctcgcgtctgattagctagttggtggtgtaagggactaccaaggcgacgatcagtagctggtctgagaggatgatcagccacactggaactgagacacggtccagactcctacgggaggcagcagtggggaattttccgcaatgggcgaaagcctgacggagcaataccgcgtgagggaggaaggctcttgggttgtaaacctcttttctcaaggaagaatgatgacggtacttgaggaatcagcatcggctaactccgtgccagcagccgcggtaatacggaggatgcaagcgttatccggaatgattgggcgtaaagcgtccgtaggtggctgtgtgtgtctattgttaaagagtttggctcaaccaaataagggcggtagaaactacacagctagagtgcgttcggggcagagggaattcctggtgtagcggtgaaatgcgtagagatcaggaagaacaccggtggcgaaagcgctctgctaggccgcaactgacactgagggacgaaagctaggggagcgaatgggattagataccccagtagtcctagccgtaaacgatggatactaggcgttgagagtatcgaccctctcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtctggaatctctgggaaactagagagtgccttcgggagccagaacacaggtggtgcatggctgtcgtcagctcgtgtcgtgagatgttgggttaagtcccgcaacgagcgcaaccctcgtacttagttgccagcatttaggatgggcactctaaggagactgccggtgacaaaccggaggaaggtggggatgacgtcaagtcagcatgccccttacgtcctgggctacacacgtactacaatgctacggacaaagggcagcgagactgcgaagttaagcaaatctcagaaaccgtggctcagttcagatcgcaggctgcaactcgcctgcgtgaaggaggaatcgctagtaattgcaggtcagcatactgcagtgaattcgttcccgggccttgtacacaccgcccgtcacaccatggaagctggtcacgcccgaagtcgttaccctaactgttcgcagagggggatgccgaaggtaggactggtgactggggtgaagtcgtaacaaggtagccgtaccggaaggtgtggctggatcacctccttttt

SEQ ID NO: 4210 - DNA, 1518 bp, Harryflintia acetispora
  ref <308>: DATABASE ACCESSION NUMBER: NCBI ACCESSION: NZ_QVEO01000049.1
  ref <309>: DATABASE ENTRY DATE: 2019-04-01
  ref <313>: RELEVANT RESIDUES IN SEQ ID NO: (1)..(1518)
atttctaaagagtttgatcctggctcaggacgaacgctggcggcgcgcctaacacatgcaagtcgaacggagaaatgctgagcttgctttgcattttttagtggcggacgggtgagtaacacgtgagcaacctgcctttgtgaggggaataacgtctggaaacggacgctaataccgcataacgtcaaggaaccgcatggttttttgaccaaagattttatcgcacaaagatgggctcgcggctgattagctagttggcggggtaacggcccaccaaggcgacgatcagtagccggactgagaggttgatcggccacattgggactgagacacggcccagactcctacgggaggcagcagtgggggatattgcacaatgggggaaaccctgatgcagcgacgccgcgtgagggaagacggttttcggattgtaaacctctgtcttcagggacgaaatcaatgacggtacctgaggaggaagccacggctaactacgtgccagcagccgcggtaatacgtaggtggcaagcgttgtccggaattactgggtgtaaagggagcgtaggcgggaatgcaagttgaatgtttaaactatcggctcaactgataatcgcgttcaaaactgcatttcttgagtggagtagaggcaggcggaattcctagtgtagcggtgaaatgcgtagatattaggaggaacaccagtggcgaaggcggcctgctgggctctaactgacgctgaggctcgaaagcgtgggtagcaaacaggattagataccctggtagtccacgccgtaaacgatgattactaggtgtggggggactgaccccttccgtgccggagttaacacaataagtaatccacctggggagtacggtcgcaagactgaaactcaaaggaattgacgggggcccgcacaagcagtggagtatgtggtttaattcgaagcaacgcgaagaaccttaccaggtcttgacatcgtgcgcataccgtagagatacgggaagtccttcgggacgcatagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcacttaacagagggaagcaagaccgcgaggtggagcaaacccccaaaaagtgtctcagttcggattgcaggctgcaacccgcctgtatgaagtcggaattgctagtaatcgcggatcagcatgccgcggtgaatacgttcccgggccttgtacacaccgcccgtcacaccatgagagccggtaacacccgaagtcagtagcctaaccgcaaggagggcgctgccgaaggtgggattggtgattagggtgaagtcgtaacaaggtagccgtatcggaaggtgcggctggatcacctcctttcta

SEQ ID NO: 4211 - DNA, 1468 bp, Hasllibacter halocynthiae
  ref <308>: DATABASE ACCESSION NUMBER: NCBI ACCESSION: NZ_PVTT01000002.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcttaatacatgcaagtcgagcgcaccttcgggtgagcggcggacgggtgagtaacgcgtgggaatgtgccctttggtacggaatagccttgggaaaccgagagtaataccgtatgtgcccttcgggggaaagatttatcgccaaaggatcagcccgcgttggattaggtagttggtggggtaatggcctaccaagccgacgatccatagctggtttgagaggatgatcagccacactgggactgagacacggcccagactcctacgggaggcagcagtagggaatcttagacaatgggcgaaagcctgatctagccatgccgcgtgtgtgacgacggccctagggtcgtaaagcactttcgccagggatgataatgacagtacctggtaaagaaaccccggctaactccgtgccagcagccgcggtaatacggagggggttagcgttgttcggaattactgggcgtaaagcgcgcgtaggcggactacccagtcagaggtgaaatcccagggctcaaccctggaactgcctttgatactagtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggtttctcgagagagattccttcagttcggctggatcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcatctacagtgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacggtgcgctaaccttcgggaggcagccggccacggtaggatcagcgactggggtgaagtcgtaacaaggtagccgtaggggaacctgcggctggatcacctcctttctaa

SEQ ID NO: 4212 - DNA, 1506 bp, Helicobacter acinonychis
  ref <308>: DATABASE ACCESSION NUMBER: NCBI ACCESSION: NZ_UGIA01000001.1
  ref <309>: DATABASE ENTRY DATE: 2019-04-01
  ref <313>: RELEVANT RESIDUES IN SEQ ID NO: (1)..(1506)
tttatggagagtttgatcctggctcagagtgaacgctggcggcgtgcctaatacatgcaagtcgaacgatgaagcttctagcttgctagaagtggattagtggcgcacgggtgagtaacgcataggttatgtgcctcttagtttgggatagccattggaaacggtgattaataccagatattccctacgggggaaagatttatcgctaagagatcagcctatgccctatcagcttgttggtaaggtaatggcttaccaaggctatgacgggtatccggcctgagagggtgaacggacacactggaactgagacacggtccagactcctacgggaggcagcagtagggaatattgctcaatgggggaaaccctgaagcagcaacgccgcgtggaggatgaaggttttaggattgtaaactccttttgtcagagaagataatgacggtatctgacgaataagcaccggctaactccgtgccagcagccgcggtaatacggagggtgcaagcgttactcggaatcactgggcgtaaagagcgcgtaggcgggatagtcagtcaggtgtgaaatcctatggcttaaccatagaactgcatttgaaactgctattctagagtgtgggagaggcaggtggaattcttggtgtaggggtaaaatccgtagagatcaagaggaatactcattgcgaaggcgacctgctagaacatgactgacgctgattgcgcgaaagcgtggggagcaaacaggattagataccctggtagtccacgccctaaacgatggatgctagttgttggagggcttagtctctccagtaatgcagctaacgccttaagcatcccgcctggggagtacggtcgcaagattaaaactcaaaggaatagacggggacccgcacaagcggtggagcatgtggtttaattcgaggatacacgaagaaccttacctaggcttgacattgagagaatccgctagaaatagcggggtgtctggcttgccagaccttgaaaacaggtgctgcacggctgtcgtcagctcgtgtcgtgagatgttgggttaagtcccgcaacgagcgcaaccctctttcttagttgctaacaggtcatgctgagaactctaaggagactgcctccgtaaggaggaggaaggtggggacgacgtcaagtcatcatggcccttacgcctagggctacacacgtgctacaatggggtgcacaaagagaagcgatactgcgaagtggagccaatcttcaaaacacctcccagttcggattgcaggctgcaactcgcctgcatgaagccggaatcgctagtaatcgcaaatcagccatgttgcggtgaatacgttcccgggtcttgtactcaccgcccgtcacaccatgggagttgtgtttgccttaagtcaggatgctaaagcagctactgcccacggcacacacagcgactggggtgaagtcgtaacaaggtaaccgtaggtgaacctgcggttggatcacctcctttcta

SEQ ID NO: 4213 - DNA, 1503 bp, Helicobacter ailurogastricus
  ref <308>: DATABASE ACCESSION NUMBER: NCBI ACCESSION: NZ_FZLU01000013.1
  ref <309>: DATABASE ENTRY DATE: 2019-04-01
  ref <313>: RELEVANT RESIDUES IN SEQ ID NO: (1)..(1503)
tttatggagagtttgatcctggctcagagtgaacgctggcggcgtgcctaatacatgcaagtcgaacgatgaagcctagcttgctaggtggattagtggcgcacgggtgagtaacgcatagatgacatgccctttagtttgggatagccactagaaatggtgattaataccaaatactaccctatgggggaaagatttatcgctaaaggattggtctatgtcctatcagcttgttggtgaggtaaaggctcaccaaggctatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgtcagagaagatcatgacggtatctgacgaataagcaccggctaactccgtgccagcagccgcggtaatacggagggtgcaagcgttactcggaatcactgggcgtaaagagtgcgtaggcggagtggcaagtcagatgtgaaatcctatggcttaaccatagaactgcatttgaaactgccaccctagagtgtgggagaggtaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtcctcccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaatctgctagaaatagcggagtgtctagcttgctagaccctgaaaacaggtgctgcacggctgtcgtcagctcgtgtcgtgagatgttgggttaagtcccgcaacgagcgcaaccctctttcttagttgctaacaggtgatgcttgagcactctaagaagactgcctgcgtaagcaggaggaaggtgaggacgacgtcaagtcatcatggcccttacgcctagggctacacacgtgctacaatggggtgcacaaagagatgcaatgccgcgaggttgagctaatctataaaacacctcttagttcggattgtaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaggtagctactgcccacggcacacacagcgactggggtgaagtcgtaacaaggtaaccgtaggtgaacctgcggttggatcacctcctttct

SEQ ID NO: 4214 - DNA, 1498 bp, Helicobacter apodemus
  ref <308>: DATABASE ACCESSION NUMBER: NCBI ACCESSION: NZ_CP021886.1
  ref <309>: DATABASE ENTRY DATE: 2019-04-01
  ref <313>: RELEVANT RESIDUES IN SEQ ID NO: (1)..(1498)
tttttggagagtttgatcctggctcagagtgaacgctggcggcgtgcctaatacatgcaagtcgaacgatgaagcttttagcttgctagaagtggattagtggcgcacgggtgagtaatgcataggttatgtgcctcatagtctaggatagccattggaaacgatgattaatactggatactccctacgggggaaagtttttcgctatgagatcagcctatgtcctatcagcttgttggtgaggtaatggctcaccaaggctatgacgggtatccggcctgagagggtgaacggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagcgcgtaggcggaatagcaagtcagatgtgaaatcctatggcttaaccatagaactgcatttgaaactgttattctagagtatgggagaggtaggtggaattcttggtgtaggggtaaaatccgtagagatcaagaggaatactcattgcgaaggcgacctgctagaacataactgacgctgatgcgcgaaagcgtggggagcaaacaggattagataccctggtagtccacgccctaaacgatgaatgctagttgttgcggagcttgtctctgcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatcctatagagatatgggagtgcccttttagggagcttgaaaacaggtgctgcacggctgtcgtcagctcgtgtcgtgagatgttgggttaagtcccgcaacgagcgcaaccctcgtccttagttgctaactatttggtagagcactctaaggagactgcctccgtaaggaggaggaaggtgaggatgacgtcaagtcatcatggcccttacgcctagggctacacacgtgctacaatgggaagtacaaaaagatgcaatattgtgaaatggagcaaatctcaaaaacttctctcagttcggattgtagtctgcaactcgactacatgaagctggaatcgctagtaatcgcaaatcagcaatgttgcggtgaatacgttcccgggtcttgtactcaccgcccgtcacaccatgggagttgtattcgccttaagtcggaatgccaaactggctaccgcccacggcggatgcagcgactggggtgaagtcgtaacaaggtaaccgtaggtgaacctgcggttggatcacctcctttc

SEQ ID NO: 4215 - DNA, 1498 bp, Helicobacter aurati
  ref <308>: DATABASE ACCESSION NUMBER: NCBI ACCESSION: NZ_FZPM01000019.1
  ref <309>: DATABASE ENTRY DATE: 2019-04-01
  ref <313>: RELEVANT RESIDUES IN SEQ ID NO: (1)..(1498)
ttttggagagtttgatcctggctcagagtgaacgctggcggcgtgcctaatacatgcaagtcgaacgatgaagcttctagcttgctagaagtggattagtggcgcacgggtgagtaatacataggttatgtgcctcatagtctaggatagccattggaaacgatgattaatactggatactccttatgagggaaagtttttcgctatgagatcagcctatgtcctatcagcttgttggtgaggtaatggctcaccaaggctatgacgggtatccggcctgagagggtgaacggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagtgcgcaggcggggtagtaagtcagatgtgaaaggctatggcttaaccatagaactgcatttgaaactgctactcttgagtatgggagaggtaggtggaattcttggtgtaggggtaaaatccgtagagatcaagaggaatactcattgcgaaggcgacctactggaacattactgacgctcatgcacgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatctgctagagatagtggagtgcctttcggggagcttgaaaacaggtgctgcacggctgtcgtcagctcgtgtcgtgagatgttgggttaagtcccgcaacgagcgcaaccctcgtccttagttgctagcagttcggctgagcactctaaggagactgccttcgtaaggaggaggaaggtgaggacgacgtcaagtcatcatggcccttacgcctagggctacacacgtgctacaatggggtgcacaaagagacgcaataccgcgaggtggagcaaatcttgaaaacatctctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagtcggaatgccaaactggctaccgcccacggcggatgcagcgactggggtgaagtcgtaacaaggtaaccgtaggtgaacctgcggttggatcacctcctttcta

SEQ ID NO: 4216 - DNA, 1502 bp, Helicobacter baculiformis
  ref <308>: DATABASE ACCESSION NUMBER: NCBI ACCESSION: NZ_FZMF01000067.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcctagcttgctaggcggattagtggcgcacgggtgagtaacgcatagatgacatgccctttagtttgggatagccactagaaatggtgattaataccaaatattaccctacgggggaaagatttatcgctaaaggattggtctatgtcctatcagcttgttggtgaggtaaaggctcaccaaggctatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgtcagagaagataatgacggtatctgacgaataagcaccggctaactccgtgccagcagccgcggtaatacggagggtgcaagcgttactcggaatcactgggcgtaaagagtgcgtaggcggggttgtaagtcaggtgtgaaatcctatggcttaaccatagaactgcatttgaaactacaaccctagagtgtgggagaggcaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtcctcccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaatctgctagaaatagcggggtgtctagcttgctagaccctgaaaacaggtgctgcacggctgtcgtcagctcgtgtcgtgagatgttgggttaagtcccgcaacgagcgcaaccctctttcttagttgctaacaggttaagctgagctctctaagaagactgcctgcgtaagcaggaggaaggtgaggacgacgtcaagtcatcatggcccttacgcctagggctacacacgtgctacaatggggtgcacaaagagatgcaatgccgcgaggttgagctaatcttaaaaacatctctcagttcggattgcaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagtagctactgcccacggcacacacagcgactggggtgaagtcgtaacaaggtaaccgtaggtgaacctgcggttggatcacctcctttct

SEQ ID NO: 4217 - DNA, 1679 bp, Helicobacter bilis
  ref <308>: DATABASE ACCESSION NUMBER: NCBI ACCESSION: NZ_FZMS01000020.1
  ref <309>: DATABASE ENTRY DATE: 2019-04-01
  ref <313>: RELEVANT RESIDUES IN SEQ ID NO: (1)..(1679)
ttacggagagtttgatcctggctcagagtgaacgctggcggcgtgcctaatacatgcaagtcgaacgatgaaacttctagcttgctagaagtggattagtggcgcacgggtgagtaatgcataggtaacatgccctttagtctgggatagccactggaaacggtgattaatactggatactccctacgggggaaaggggctttcaataaagaatttctctttttagtgttttgtgttgttggcacaaaattctagtatttggaatgagaaattggtgttgtgaagcaatttgtgcggagattagacttagtgtctgtcgtgtcagcaaattgcgaactcatcgatttatcatccaaagacgaattttttattgaaagccttcgctaaaggattggcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttaggattgtaaactccttttgtaagagaagattatgacggtatcttacgaataagcaccggctaactccgtgccagcagccgcggtaatacggagggtgcaagcgttactcggaatcactgggcgtaaagagcgcgtaggcgggtggtcaagtcagatgtgaaatcctgtagcttaactacagaactgcatttgaaactgaccatctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgtgaggcttgtccttgcagtaatgcagctaacgcattaagcattccgcctggggagtacggtcgcaagattaaaactcaaaggaatagacggggacccgcacaagcggtggagcatgtggtttaattcgatgatacgcgaagaaccttacctaggcttgacattgatagaatctactagagatagtggagtgcccttttagggagcttgaaaacaggtgctgcacggctgtcgtcagctcgtgtcgtgagatgttgggttaagtcccgcaacgagcgcaaccctcgtccttagttgctagcagtttggctgagcactctaaggagactgccttcgtaaggaggaggaaggtgaggacgacgtcaagtcatcatggcccttacgcctagggctacacacgtgctacaatggggtgcacaaagagatgcaatagtgtgagctggagccaatctctaaaacatctctcagttcggattgtagtctgcaactcgactacatgaagctggaatcgctagtaatcgcaaatcagcaatgttgcggtgaatacgttcccgggtcttgtactcaccgcccgtcacaccatgggagttgtatttgccttaagtcggaatgctaaattggctaccgcccacggcagatgcagcgactggggtgaagtcgtaacaaggtaaccgtaggtgaacctgcggttggatcacctcctttcta

SEQ ID NO: 4218 - DNA, 1507 bp, Helicobacter bizzozeronii
  ref <308>: DATABASE ACCESSION NUMBER: NCBI ACCESSION: NZ_FZMK01000027.1
  ref <309>: DATABASE ENTRY DATE: 2019-04-01
  ref <313>: RELEVANT RESIDUES IN SEQ ID NO: (1)..(1507)
ttaactttatggagagtttgatcctggctcagagtgaacgctggcggcgtgcctaatacatgcaagtcgaacgatgaagcctagcttgctaggcggattagtggcgcacgggtgagtaacgcatagatgacatgccctttagtttgggatagccactagaaatggtgattaataccaaatactaccctacgggggaaagatttatcgctaaaggattggtctatgtcctatcagcttgttggtgaggtaaaggctcaccaaggcaatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgtcagagaagataatgacggtatctgacgaataagcaccggctaactccgtgccagcagccgcggtaatacggagggtgcaagcgttactcggaatcactgggcgtaaagagtgcgtaggcggggttgtaagtcagatgtgaaatcctatggcttaaccatagaactgcatttgaaactgcaactctggagtgtgggagaggtaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtccccccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaatcccctagaaataggggagtgtctagcttgctagaccctgaaaacaggtgctgcacggctgtcgtcagctcgtgtcgtgagatgttgggttaagtcccgcaacgagcgcaaccctctttcttagttgctaacaggttaagctgagctctctaagaatactgcctgcgtaagcaggaggaaggtgaggacgacgtcaagtcatcatggcccttacgcctagggctacacacgtgctacaatggggtgtacaaagagatgcaatgccgcgaggctgagccaatcttaaaaacatctctcagttcggattgcaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagtagctactgcccacggcacacacagcgactggggtgaagtcgtaacaaggtaaccgtaggtgaacctgcggttggatcacctcctttct

SEQ ID NO: 4219 - DNA, 1508 bp, Helicobacter cetorum
  ref <308>: DATABASE ACCESSION NUMBER: NCBI ACCESSION: NZ_FZMR01000008.1
  ref <309>: DATABASE ENTRY DATE: 2019-04-01
  ref <313>: RELEVANT RESIDUES IN SEQ ID NO: (1)..(1508)
tttatggagagtttgatcctggctcagagtgaacgctggcggcgtgcctaatacatgcaagtcgaacgatgaagcttctagcttgctagaagtggattagtggcgcacgggtgagtaacgcataggttatgtgcctcttagtttgggatagccattggaaacgatgattaataccagatactccctacgggggaaagatttatcgctaagagatcagcctatgtcctatcagcttgttggtaaggtaatggcttaccaaggctatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgttagagaagataatgacggtatctaacgaataagcaccggctaactccgtgccagcagccgcggtaatacggagggtgcaagcgttactcggaatcactgggcgtaaagagcgcgtaggcgggatagtaagtcagatgtgaaatcctatggcttaaccatagaactgcatttgaaactgctattctagagtgtgggagaggtaggtggaattcttggtgtaggggtaaaatccgtagagatcaagaggaatactcattgcgaaggcgacctgctggaacattactgacgctgattgcgcgaaagcgtggggagcaaacaggattagataccctggtagtccacgccctaaacgatggatgctagttgttggggagcttagtctctccagtaatgcagctaacgcattaagcatcccgcctggggagtacggtcgcaagattaaaactcaaaggaatagacggggacccgcacaagcggtggagcatgtggtttaattcgaagatacacgaagaaccttacctaggcttgacattgagagaatccgctagaaatagtggagtgtctagcttgctagaccttgaaaacaggtgctgcacggctgtcgtcagctcgtgtcgtgagatgttgggttaagtcccgcaacgagcgcaaccccctttcttagttgctaacaggttatgctgagaactctaaggatactgcctccgtaaggaggaggaaggtggggacgacgtcaagtcatcatggcccttacgcctagggctacacacgtgctacaatggggtgtacaaagagaagcaatactgcgaagtggagcaaatctcaaaaacatctctcagttcggattgcaggctgcaactcgcctgcatgaagctggaatcgctagtaatcgtgaatcagccatgtcacggtgaatacgttcccgggtcttgtactcaccgcccgtcacaccatgggagttgtgtttgccttaagtcaggatgctaaactagctactgcccacggcacacacagcgactggggtgaagtcgtaacaaggtaaccgtaggtgaacctgcggttggatcacctcctttctaga

SEQ ID NO: 4220 - DNA, 1501 bp, Helicobacter cholecystus
  ref <308>: DATABASE ACCESSION NUMBER: NCBI ACCESSION: NZ_LR134518.1
  ref <309>: DATABASE ENTRY DATE: 2019-04-01
  ref <313>: RELEVANT RESIDUES IN SEQ ID NO: (1)..(1501)
tttatggagagtttgatcctggctcagagtgaacgctggcggcgtgcctaatacatgcaagtcgaacgatgaagcttttagcttgctagaagtggattagtggcgcacgggtgagtaatgcataggttatgtgccctttagtctgggatagccactggaaacggtgattaataccggatactccctacgggggaaagtttttcgctaaaggatcagcctatgtcctatcagcttgttggtgaggtaatggctcaccaaggctatgacgggtatccggcctgagagggtgaacggacacactggaactgagacacggtccagactcctacgggaggcagcagtagggaatattgctcaatgggcgaaagcctgaagcagcaacgccgcgtggaggatgaaggttttaggattgtaaactccttttgtgagagaagattatgacggtatctcacgaataagcaccggctaactccgtgccagcagccgcggtaatacggagggtgcaagcgttactcggaatcactgggcgtaaagagcgcgtaggcggggtagtaagtcagatgtgaaatcctatggcttaaccatagaactgcatttgaaactactactctagagtatgggagaggtaggtggaattcttggtgtaggggtaaaatccgcagagatcaagaggaatactcattgcgaaggcgacctgctggaacactactgacgctgatgcgcgaaagcgtggggagcaaacaggattagataccctggtagtccacgccctaaacgatgaatgctagttgttggggtgcttgtcactccagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatctgctagagatagcggagtgctggcttgccagagcttgaaaacaggtgctgcacggctgtcgtcagctcgtgtcgtgagatgttgggttaagtcccgcaacgagcgcaaccctcgtccttagttgctagcagttcggctgagcactctagggagactgccttcgtaaggaggaggaaggtgaggacgacgtcaagtcatcatggcccttacgcctagggctacacacgtgctacaatggtatgtacaaagagacgcaataccgcgaggtggagcaaatctcaaaaacatatctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagccgggatgctaaactggctaccgtccacggcggatgcagcgactggggtgaagtcgtaacaaggtaaccgtaggtgaacctgcggttggatcacctcctttcaa

SEQ ID NO: 4221 - DNA, 1502 bp, Helicobacter cynogastricus
  ref <308>: DATABASE ACCESSION NUMBER: NCBI ACCESSION: NZ_FZMQ01000004.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcctagcttgctaggtggattagtggcgcacgggtgagtaacgcatagatgacatgccctttagtttgggatagccactagaaatggtgattaataccaaatactaccctatgggggaaagatttatcgctaaaggattggtctatgtcctatcagcttgttggtgaggtaaaggctcaccaaggcaatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgtcagagaagataatgacggtatctgacgaataagcaccggctaactccgtgccagcagccgcggtaatacggagggtgcaagcgttactcggaatcactgggcgtaaagagtgcgtaggcggggttgtaagtcagatgtgaaatcctatggcttaaccatagaactgcatttgaaactacaactctggagtgtgggagaggtaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtcctcccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaatttgctagaaatagcgaagtgtctagcttgctagaccctgaaaacaggtgctgcacggctgtcgtcagctcgtgtcgtgagatgttgggttaagtcccgcaacgagcgcaaccctctttcttagttgctaacagatcatgctgagctctctaagaatactgcctgcgtaagcaggaggaaggtgaggacgacgtcaagtcatcatggcccttacgcctagggctacacacgtgctacaatggggtgcacaaagagatgcaatgccgcgaggctgagccaatcttaaaaacgcctctcagttcggattgcaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagtagctactgcccacggcacacacagcgactggggtgaagtcgtaacaaggtaaccgtaggtgaacctgcggttggatcacctcctttct

SEQ ID NO: 4222 - DNA, 1500 bp, Helicobacter equorum
  ref <308>: DATABASE ACCESSION NUMBER: NCBI ACCESSION: NZ_FZPO01000054.1
  ref <309>: DATABASE ENTRY DATE: 2019-04-01
  ref <313>: RELEVANT RESIDUES IN SEQ ID NO: (1)..(1500)
tttatggagagtttgatcctggctcagagtgaacgctggcggcgtgcctaatacatgcaagtcgaacgatgaagcttctagcttgctagaagtggattagtggcgcacgggtgagtaatgcataggtaacataccctttagtctgggatagccactggaaacggtgattaataccagatactccctatgggggaaagtttttcgctaaaggattggcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagcgcgtaggcggggtagcaagtcagatgtgaaatcctatggcttaactatagaactgcatttgaaactgttactctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgtgaggcttgtccttgcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatctactagagatagtggagtgcccttcggggagcttgaaaacaggtgctgcacggctgtcgtcagctcgtgtcgtgagatgttgggttaagtcccgcaacgagcgcaaccctcgtccttagttgctagcagtttggctgagcactctaaggagactgccttcgtaaggaggaggaaggtgaggacgacgtcaagtcatcatggcccttacgcctagggctacacacgtgctacaatggggtgcacaaagagaagcaatactgcgaagtggagccaatctcaaaaacatctctcagttcggattgtagtctgcaactcgactacatgaagctggaatcgctagtaatcgcaaatcagccatgttgcggtgaatacgttcccgggtcttgtactcaccgcccgtcacaccatgggagttgtatttgccttaagtcggaatgctaaactggctaccgcccacggcagatgcagcgactggggtgaagtcgtaacaaggtaaccgtaggtgaacctgcggttggatcacctcctttctag

SEQ ID NO: 4223 - DNA, 1502 bp, Helicobacter felis
  ref <308>: DATABASE ACCESSION NUMBER: NCBI ACCESSION: NZ_FZNI01000047.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcctagcttgctaggtggattagtggcgcacgggtgagtaacgcatagatgacatgccctttagtttgggatagccactagaaatggtgattaataccaaataccaccctacgggggaaagatttatcgctaaaggattggtctatgtcctatcagcttgttggtgaggtaaaggctcaccaaggcgatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgtcagagaagataatgacggtatctgacgaataagcaccggctaactccgtgccagcagccgcggtaatacggagggtgcaagcgttactcggaatcactgggcgtaaagagtgcgtaggcggggttgtaagtcagatgtgaaatcctatggcttaaccatagaactgcatttgaaactacaactctggagtgtgggagaggtaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtcctcccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaattccctagaaataggggagtgcctagcttgctaggccctgaaaacaggtgctgcacggctgtcgtcagctcgtgtcgtgagatgttgggttaagtcccgcaacgagcgcaaccctctttcttagttgctaacaggtcatgctgagctctctaagaatactgcctgcgtaagcaggaggaaggtgaggacgacgtcaagtcatcatggcccttacgcctagggctacacacgtgctacaatggggtgcacaaagagatgcaatgccgcgaggctgagccaatcttaaaaacgcctctcagttcggattgcaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagtagctactgcccacggcacacacagcgactggggtgaagtcgtaacaaggtaaccgtaggtgaacctgcggttggatcacctcctttct

SEQ ID NO: 4224 - DNA, 1854 bp, Helicobacter fennelliae
  ref <308>: DATABASE ACCESSION NUMBER: NCBI ACCESSION: NZ_UAWL01000006.1
  ref <309>: DATABASE ENTRY DATE: 2019-04-01
  ref <313>: RELEVANT RESIDUES IN SEQ ID NO: (1)..(1854)
tttacggagagtttgatcctggctcagagtgaacgctggcggcgtgcctaatacatgcaagtcgaacgatgaagtctctagcttgctagagatggattagtggcgcacgggtgagtaatgcatagataacatgccctttagtctaggatagccactggaaacggtgattaatactggatacttcttacgagagaaagggactcttaatagagaattcaagcttttgagtgcttttacgggagcttgaaatttttaaactacgatgaactttaatgttctatcttgtttaaaaatttctgcgcaacccacaaaatcatctcaaaatcttagaattctagaatctccaaaacacagaatctaaatttcaagattctgtaaaagattaggattttagaatctagagcaagaattgggattgtgcgtaagatttgcaagttttcaagaaaaaggtgcagggagttacctaagcggtaatgaccaagcctttttcgcagaatcttgcaaagattgcgtgcaagtcaaattctaaagcatgaattttttattaagagtctccgctaaaggattggtctatgtcctatcagcttgttggtgaggtaatggctcaccaaggctatgacgggtatccggcctgagagggtgaacggacacactggaactgagacacggtccagactcctacgggaggcagcagtagggaatattgctcaatgggggaaaccctgaagcagcaacgccgcgtggaggatgaaggttttcggattgtaaactccttttgtgagagaagataatgacggtatctcgcgaataagcaccggctaactccgtgccagcagccgcggtaatacggagggtgcaagcgttactcggaatcactgggcgtaaagagtgcgcaggcggggtagcaagtcagatgtgaaatgctatggcttaaccatagaactgcatttgaaactgctactctagagtgtgggagaggtaggtggaattcttggtgtaggggtaaaatccgtagagatcaagaggaatactcattgcgaaggcgacctactggaacattactgacgctcatgcacgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatctgctagagatagcggagtgccatttcggtggagcttgaaaacaggtgctgcacggctgtcgtcagctcgtgtcgtgagatgttgggttaagtcccgcaacgagcgcaaccctcgtccttagttgctagcagctcggctgagcactctaaggagactgccttcgtaaggaggaggaaggtgaggacgacgtcaagtcatcatggcccttacgcctagggctacacacgtgctacaatgggatacacaaagagatgcaatattgtgaaatggagccaatctcaaaaatatctctcagttcggattgtagtctgcaactcgactacatgaagctggaatcgctagtaatcgcaaatcagccatgttgcggtgaatacgttcccgggtcttgtactcaccgcccgtcacaccatgggagttgtattcgccttaagccggaatgctaaattggctaccgtccacggcggatgcagcgactggggtgaagtcgtaacaaggtaaccgtaggtgaacctgcggttggatcacctcctttcta

SEQ ID NO: 4225 - DNA, 1502 bp, Helicobacter heilmannii
  ref <308>: DATABASE ACCESSION NUMBER: NCBI ACCESSION: NZ_FZMG01000002.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcctagcttgctaggcggattagtggcgcacgggtgagtaacgcatagatgacatgccctttagtttgggatagccactagaaatggtgattaataccaaatactaccctacgggggaaagatttatcgctaaaggattggtctatgtcctatcagcttgttggtgaggtaaaggctcaccaaggcaatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgtgagagaagataatgacggtatctcacgaataagcaccggctaactccgtgccagcagccgcggtaatacggagggtgcaagcgttactcggaatcactgggcgtaaagagtgcgtaggcggggttgtaagtcaggtgtgaaatcctatggcttaaccatagaactgcatttgaaactgcaaccctagagtgtgggagaggtaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtcctcccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaatctgctagaaatagtggagtgtctagcttgctagaccctgaaaacaggtgctgcacggctgtcgtcagctcgtgtcgtgagatgttgggttaagtcccgcaacgagcgcaaccctctttcttagttgctaacaggttaagctgagctctctaagaagactgcctgcgtaagcaggaggaaggtgaggacgacgtcaagtcatcatggcccttacgcctagggctacacacgtgctacaatggggcgcacaaagagatgcaatgccgcgaggttgagccaatcttaaaaacgcctctcagttcggattgtaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagcagctactgcccacggcacacacagcgactggggtgaagtcgtaacaaggtaaccgtaggtgaacctgcggttggatcacctcctttct

SEQ ID NO: 4226 - DNA, 1500 bp, Helicobacter marmotae
  ref <308>: DATABASE ACCESSION NUMBER: NCBI ACCESSION: NZ_FZPP01000053.1
  ref <309>: DATABASE ENTRY DATE: 2019-04-01
  ref <313>: RELEVANT RESIDUES IN SEQ ID NO: (1)..(1500)
tttatggagagtttgatcctggctcagagtgaacgctggcggcgtgcctaatacatgcaagtcgaacgatgaagcttctagcttgctagaagtggattagtggcgcacgggtgagtaacgcatagataacatgccctttagtctgggatagccactggaaacggtgattaatactagatactccctacgggggaaagaatttcgctaaaggattggtctatgtcctatcagcttgttggtgaggtaatggctcaccaaggctatgacgggtatccggcctgagagggtgaacggacacactggaactgagacacggtccagactcctacgggaggcagcagtagggaatattgctcaatgggggaaaccctgaagcagcaacgccgcgtggaggatgaaggttttaggattgtaaactccttttgttagagaagattatgacggtatctaacgaataagcaccggctaactccgtgccagcagccgcggtaatacggagggtgcaagcgttactcggaatcactgggcgtaaagagtgcgcaggcgggtaattaagtcagatgtgaaatcctatagcttaactatagaactgcatttgaaactgattatctagagtgtgggagaggtaggtggaattcttggtgtaggggtaaaatccgtagagatcaagaggaatactcattgcgaaggcgacctactggaacattactgacgctcatgcacgaaagcgtggggagcaaacaggattagataccctggtagtccacgccctaaacgatgaatgctagttgttgtggagcttgtctctgcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatccgctagagatagtggagtgcccctttggggagcttgaaaacaggtgctgcacggctgtcgtcagctcgtgtcgtgagatgttgggttaagtcccgcaacgagcgcaaccctcgtccttagttgctagcagttcggctgagcactctaaggagactgccttcgtaaggaggaggaaggtgaggacgacgtcaagtcatcatggcccttacgcctagggctacacacgtgctacaatgggaagtacaaaaagatgcaatatcgcgaggtggagcaaatcttaaaaacttctctcagttcggattgtagtctgcaactcgactacatgaagctggaatcgctagtaatcgcaaatcagccatgttgcggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgtaggtgaacctgcggttggatcacctcctttcta

SEQ ID NO: 4227 - DNA, 1498 bp, Helicobacter mesocricetorum
  ref <308>: DATABASE ACCESSION NUMBER: NCBI ACCESSION: NZ_FZPJ01000004.1
  ref <309>: DATABASE ENTRY DATE: 2019-04-01
  ref <313>: RELEVANT RESIDUES IN SEQ ID NO: (1)..(1498)
ttttggagagtttgatcctggctcagagtgaacgctggcggcgtgcctaatacatgcaagtcgaacgatgaagcttctagcttgctagaagtggattagtggcgcacgggtgagtaatacataggttatgtgcctcatagtctaggatagccattggaaacgatgattaatactggatactccttatgagggaaagtttttcgctatgagatcagcctatgtcctatcagcttgttggtgaggtaatggctcaccaaggctatgacgggtatccggcctgagagggtgaacggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagcgcgtaggcggaatagcaagtcagatgtgaaatcctatggcttaaccatagaactgcatttgaaactgttattctagagtatgggagaggtaggtggaattcttggtgtaggggtaaaatccgtagagatcaagaggaatactcattgcgaaggcgacctactagaacattactgacgctgatgcgcgaaagcgtggggagcaaacaggattagataccctggtagtccacgccctaaacgatgaatgctagttgttgtgaagcttgtctttgcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatctgctagagatagcggagtgctagcttgctagaacttgaaaacaggtgctgcacggctgtcgtcagctcgtgtcgtgagatgttgggttaagtcccgcaacgagcgcaaccctcgtccttagttgctaacagtttagctgagcactctaaggagactgccttcgcaaggaggaggaaggtgaggatgacgtcaagtcatcatggcccttacgcctagggctacacacgtgctacaatgggaagtacaaaaagatgcaatattgtgaaatggagcaaatctcaaaaacttctctcagttcggattgtagtctgcaactcgactacataaagctggaatcgctagtaatcgcaaatcagcaatgttgcggtgaatacgttcccgggtcttgtactcaccgcccgtcacaccatgggagttgtattcgccttaagtcggaatgccaaataggctaccgcccacggcggatgcagcgactggggtgaagtcgtaacaaggtaaccgtaggtgaacctgcggttggatcacctcctttc

SEQ ID NO: 4228 - DNA, 1502 bp, Helicobacter mustelae
  ref <308>: DATABASE ACCESSION NUMBER: NCBI ACCESSION: NZ_LS483446.1
  ref <309>: DATABASE ENTRY DATE: 2019-04-01
  ref <313>: RELEVANT RESIDUES IN SEQ ID NO: (1)..(1502)
attatggagagtttgatcctggctcagagtgaacgctggcggcgtgcctaatacatgcaagtcgaacgatgaagcttctagcttgctagaagtggattagtggcgcacgggtgagtaacgcataggttatgtgccccatagtctgggatagccactggaaacggtgattaatactggatactccctacgggggaaagtttttcgctatgggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggcgaaagcctgaagcagcaacgccgcgtggaggatgaaggttttaggattgtaaactccttttctaagagaagataatgacggtatcttaggaataagcaccggctaactccgtgccagcagccgcggtaatacggagggtgcaagcgttactcggaatcactgggcgtaaagagcgcgtaggcggagtaataagtcagatgtgaaatcctgtagcttaactacagaactgcatttgaaactgttattctagagtgtgggagaggtaggtggaattcttggtgtaggggtaaaatccgtagagatcaagaggaatactcattgcgaaggcgacctactggaacattactgacgctgatgcgcgaaagcgtggggagcaaacaggattagataccctggtagtccacgccctaaacgatgaatgctagttgttggggtgcttgtcactccagtaatgcagttaacacattaagcattccgcctggggagtacggtcgcaagattaaaactcaaaggaatagacggggacccgcacaagcggtggagcatgtggtttaattcgatgctacgcgaagaaccttacctaggcttgacattgatagaatctgctagaaatagcggagtgtctagtttactagaccttgaaaacaggtgctgcacggctgtcgtcagctcgtgtcgtgagatgttgggttaagtcccgcaacgagcgcaaccctcgttcttagttgctagcagttcggctgagcactctaagaagactgccttcgtaaggaggaggaaggtgaggacgacgttaagtcatcatggcccttacgcctagggctacacacgtgctacaatggggtgcacaaagagacgcaataccgcgaggtggagcaaatctcaaaaacatctctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagccgggatgctaaattggctaccgtccacggcggatgcagcgactggggtgaagtcgtaacaaggtaaccgtaggtgaacctgcggttggatcacctcctttcta

SEQ ID NO: 4229 - DNA, 1548 bp, Helicobacter pametensis
  ref <308>: DATABASE ACCESSION NUMBER: NCBI ACCESSION: NZ_UYIU01000001.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcgaacggcagcggggtagtgcttgcactactgccggcgagtggcgaacgggtgagtaatatatcggaacgtaccgagtaatgggggataaccaatcgaaagattggctaataccgcatacgtcctgagggagaaagcgggggatcgcaagacctcgcgttattcgagcggccgataactgattagctagttggtggggtaaaggcctaccaaggcgacgatcagtagcgggtctgagaggacgatccgccacactgggactgagacacggcccagactcctacgggaggcagcagtggggaattttggacaatgggggcaaccctgatccagccatgccgcgtgtatgaagaaggccttcgggttgtaaagtacttttgttagggaagaaaagggaagtgctaataccactttttgctgacggtacctaaagaataagcaccggctaactacgtgccagcagccgcggtaatacgtagggtgcgagcgttaatcggaattactgggcgtaaagcgagcgcagacggttatttaagcaggatgtgaaatccccgggctcaacctgggaactgcgttctgaactggatagctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcgattagctgttggggtacatgataccttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggttttgacatgtacggaaccctttagagataggggggtgccttcgggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgaccagggcttcacacgtcatacaatggtcggtacagagggtagccaagccgcgaggcggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtagggtaaccgcaaggagcccgcttgccacggtatgcttcatgactggggtgaagtcgtaacaaggtagccgtaggggaacctgcggctggatcacctcctttctag

SEQ ID NO: 4230 - DNA, 1499 bp, Helicobacter pullorum
  ref <308>: DATABASE ACCESSION NUMBER: NCBI ACCESSION: NZ_LR134509.1
  ref <309>: DATABASE ENTRY DATE: 2019-04-01
  ref <313>: RELEVANT RESIDUES IN SEQ ID NO: (1)..(1499)
tttatggagagtttgatcctggctcagagtgaacgctggcggcgtgcctaatacatgcaagtcgaacgatgaagcttttagcttgctagaagtggattagtggcgcacgggtgagtaatgcataggttatgtgccctttagtctgggatagccactggaaacggtgattaatactagatactccctacgggggaaagtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagcgcgtaggcggggtagtaagtcagatgtgaaatcctatggcttaaccatagaactgcatttgaaactactactctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgtgaggcttgtccttgcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatctgctagagatagcggagtgctggcttgccagagcttgaaaacaggtgctgcacggctgtcgtcagctcgtgtcgtgagatgttgggttaagtcccgcaacgagcgcaaccctcgtccttagttgctagcagttcggctgagcactctaaggagactgccttcgtaaggaggaggaaggtgaggatgacgtcaagtcatcatggcccttacgcctagggctacacacgtgctacaatggggtgtacaaagagaagcaatactgcgaagtggagccaatctctaaaacatctctcagttcggattgtagtctgcaactcgactacatgaagctggaatcgctagtaatcgcaaatcagccatgttgcggtgaatacgttcccgggtcttgtactcaccgcccgtcgcaccatgggagttgtattcgccttaagtcggaatactaaactagttaccgcccacggcggatgcagcgactggggtgaagtcgtaacaaggtaaccgtaggtgaacctgcggttggatcacctcctttc

SEQ ID NO: 4231 - DNA, 1509 bp, Helicobacter pylori
  ref <308>: DATABASE ACCESSION NUMBER: NCBI ACCESSION: NZ_LR134519.1
  ref <309>: DATABASE ENTRY DATE: 2019-04-01
  ref <313>: RELEVANT RESIDUES IN SEQ ID NO: (1)..(1509)
tttatggagagtttgatcctggctcagagtgaacgctggcggcgtgcctaatacatgcaagtcgaacgatgaagcttctagcttgctagaaggctgattagtggcgcacgggtgagtaacgcataggttatgtgcctcttagtttgggatagccattggaaacgatgattaataccagatactccctacgggggaaagattcatcgctaagagatcagcctatgtcctatcagcttgttggtaaggtaatggcttaccaaggctatgacgggtatccggcctgagagggtgaacggacacactggaactgagacacggtccagactcctacgggaggcagcagtagggaatattgctcaatgggggaaaccctgaagcagcaacgccgcgtggaggatgaaggttttaggattgtaaactccttttgttagagaagataatgacggtatctaacgaataagcaccggctaactccgtgccagcagccgcggtaatacggagggtgcaagcgttactcggaatcactgggcgtaaagagcgcgtaggcgggatagtcagtcaggtgtgaaatcctatggcttaaccatagaactgcatttgaaactactattctagagtgtgggagaggtaggtggaattcttggtgtaggggtaaaatccgtagagatcaagaggaatactcattgcgaaggcgacctgctggaacattactgacgctgattgcacgaaagcgtggggagcaaacaggattagataccctggtagtccacgccctaaacgatggatgctagttgttggagggcttagcctctccagtaatgcagctaacgcattaagcatcccgcctggggagtacggtcgcaagattaaaactcaaaggaatagacggggacccgcacaagcggtggagcatgtggtttaattcgaagatacacgaagaaccttacctaggcttgacattgagagaatccgctagaaatagtggagtgtctggcttgccagaccttgaaaacaggtgctgcacggctgtcgtcagctcgtgtcgtgagatgttgggttaagtcccgcaacgagcgcaaccccctttcttagttgctaacaggttatgctgagaactctaaggatactgcctccgtaaggaggaggaaggtggggacgacgtcaagtcatcatggcccttacgcctagggctacacacgtgctacaatggggtgcacaaagagaagcaatactgcgaagtggagccaatcttcaaaacacctctcagttcggattgtaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaattggctactgcccacggcacacacagcgactggggtgaagtcgtaacaaggtaaccgtaggtgaacctgcggttggatcacctcctttctaga

SEQ ID NO: 4232 - DNA, 1502 bp, Helicobacter rappini
  ref <308>: DATABASE ACCESSION NUMBER: NCBI ACCESSION: NZ_FZPK01000003.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcttctagcttgctagaagtggattagtggcgcacgggtgagtaatgcataggttatgtgccctttagtctgggatagccactggaaacggtgattaatactggatactccctacgggggaaaggtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttaggattgtaaactccttttgttagagaagattatgacggtatctaacgaataagcaccggctaactccgtgccagcagccgcggtaatacggagggtgcaagcgttactcggaatcactgggcgtaaagagcgcgtaggcgggtggtcaagtcagatgtgaaatcctgtagcttaactacagaactgcatttgaaactgaccatctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagctacgcgaagaaccttacctaggcttgacattgatagaatccgctagagatagtggagtgctggcttgccagagcttgaaaacaggtgctgcacggctgtcgtcagctcgtgtcgtgagatgttgggttaagtcccgcaacgagcgcaaccctcgtccttagttgctagcagctcggctgagcactctaaggagactgccttcgtaaggaggaggaaggtgaggacgacgtcaagtcatcatggcccttacgcctagggctacacacgtgctacaatgggacatacaaaaagatgcaataccgcgaggtggagcaaatctctaaaatgtctctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgtaggtgaacctgcggttggatcacctcctttcta

SEQ ID NO: 4233 - DNA, 2379 bp, Helicobacter saguini
  ref <308>: DATABASE ACCESSION NUMBER: NCBI ACCESSION: NZ_CP028938.1
  ref <309>: DATABASE ENTRY DATE: 2019-04-01
  ref <313>: RELEVANT RESIDUES IN SEQ ID NO: (1)..(2379)
tttatggagagtttgatcctggctcagagtgaacgctggcggcgtgcctaatacatgcaagtcgaacgatgaagcttttagcttgctagaagtggattagtggcgcacgggtgagtaacgcatagataacatgccctttagtctgggatagccattggaaacgatgattaatactagatacaccctatgggggaaagtggctcttaaataagaatttgagtgtgttttgtggtttctttaaatgtttagattctaaagattaaaaacatagaatctaggattctataaactttaaaagatttggcgggttagtgataaatggataaagcttaagagttttatcctatcgcccacccaccgccctttttggtggagtttgtagaatcttgttttagattctaaaggcgagtctgtaacatagaatctgaaatataaaatctgtcaaattagattctaaagattaagaacgaatcttttgagaattaagattctaatggtttatgaaatcttaaaaagtagattctaaaaacaaacgatagaatctagattttataaaactttaaaaggattgtggttttgtagtggatgataaaaaaatcaaaactttttcttatcgcccacccaccgcccttttaaatgaatgtttatagaatcttgtttttagattctaaagattttttggatttaaaaagattctaaagatttagattctatctagattcttaaaaagtgtggattgcttcgcttcgctcgcaatgactatagaatctagattctaagatttgaaataacttaattaaaaaagattctaaaggcaagtccaaatatagaatctaaaagataaaattttatagaatctttagatttaatcatttaatcaaagggttagaaaattagattttattaaattatagaatctaaaaagttagattttaaagaaaacaaattatagaatctagattctataaactttaaaggatttggttagctggtaaaaagatagaatctaatcctaatcgcccacccaccaccctttttaatggaaaacaaaacacaataaatttttatttaagagcttacgctaaaggattggtctatgtcctatcagcttgttggtgaggtaatggcttaccaaggctatgacgggtatccggcctgagagggtgaacggacacactggaactgagacacggtccagactcctacgggaggcagcagtagggaatattgctcaatgggcgaaagcctgaagcagcaacgccgcgtggaggatgaaggttttaggattgtaaactccttttgttagagaagattatgacggtatctaacgaataagcaccggctaactccgtgccagcagccgcggtaatacggagggtgcaagcgttactcggaatcactgggcgtaaagagtgcgtaggcgggaaggtaagtcagatgtgaaatcctgtagcttaactacagaactgcatttgaaactacttttctagagtgtgggagaggtaggtggaattcttggtgtaggggtaaaatccgtagagatcaagaggaatactcattgcgaaggcgacctactagaacattactgacgctcatgcacgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagatacacgaagaaccttacctaggcttgacattgatagaatctgctagagatagcggagtgtctagcttgctagaccttgaaaacaggtgctgcacggctgtcgtcagctcgtgtcgtgagatgttgggttaagtcccgcaacgagcgcaaccctcgttcttagttgctagcgcttcgggcgagcactctaagaagactgccttcgtaagaaggaggaaggtgaggacgacgtcaagtcatcatggcccttacgcctagggctacacacgtgctacaatggggtgcacaatgagatgcaatatcgcgagatggagctaatctctaaaacatctctcagttcggattgtagtctgcaactcgactacatgaagctggaatcgctagtaatcgcaaatcagccatgttgcggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgtaggtgaacctgcggttggatcacctcctttcta

SEQ ID NO: 4234 - DNA, 1502 bp, Helicobacter salomonis
  ref <308>: DATABASE ACCESSION NUMBER: NCBI ACCESSION: NZ_OANQ01000031.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcctagcttgctaggcggattagtggcgcacgggtgagtaacgcatagatgacatgccctttagtttgggatagccactagaaatggtgattaataccaaatactaccctacgggggaaagatttatcgctaaaggattggtctatgtcctatcagcttgttggtgaggtaaaggctcaccaaggcgatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgtcagagaagataatgacggtatctgacgaataagcaccggctaactccgtgccagcagccgcggtaatacggagggtgcaagcgttactcggaatcactgggcgtaaagagtgcgtaggcggggttgtaagtcagatgtgaaatcctatggcttaaccatagaactgcatttgaaactgcaactctggagtgtgggagaggtaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtccccccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaatttgctagaaatagcgaagtgtctagcttgctagaccctgaaaacaggtgctgcacggctgtcgtcagctcgtgtcgtgagatgttgggttaagtcccgcaacgagcgcaaccctctttcttagttgctaacaggtcatgctgagctctctaagaatactgcctgcgtaagcaggaggaaggtgaggacgacgtcaagtcatcatggcccttacgcctagggctacacacgtgctacaatggggtgtacaaagagatgcaatgccgcgaggctgagccaatcttaaaaacatctctcagttcggattgcaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagtagctactgcccacggcacacacagcgactggggtgaagtcgtaacaaggtaaccgtaggtgaacctgcggttggatcacctcctttct

SEQ ID NO: 4235 - DNA, 1503 bp, Helicobacter sp. 48519
  ref <308>: DATABASE ACCESSION NUMBER: NCBI ACCESSION: NZ_QXJF01000028.1
  ref <309>: DATABASE ENTRY DATE: 2019-04-01
  ref <313>: RELEVANT RESIDUES IN SEQ ID NO: (1)..(1503)
tttatggagagtttgatcctggctcagagtgaacgctggcggcgtgcctaatacatgcaagtcgaacgatgaagcttctagcttgctagaggtggattagtggcgcacgggtgagtaatgcataggttatgtgccctttagtctgggatagccactggaaacggtgattaatactggatactccctacgggggaaaggtttttcgctaaaggatcagcctatgtcctatcagcttgttggtgaggtaatggctcaccaaggctatgacgggtatccggcctgagagggtgaacggacacactggaactgagacacggtccagactcctacgggaggcagcagtagggaatattgctcaatgggggaaaccctgaagcagcaacgccgcgtggaggatgaaggttttaggattgtaaactccttttgtaagagaagattatgacggtatcttacgaataagcaccggctaactccgtgccagcagccgcggtaatacggagggtgcaagcgttactcggaatcactgggcgtaaagagcgcgtaggcgggaaagtaagtcagatgtgaaatcctgtagcttaactatagaattgcatttgaaactacttttctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgccctgcttgtcagggcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatctgctagagatagcggagtgctggcttgccagagcttgaaaacaggtgctgcacggctgtcgtcagctcgtgtcgtgagatgttgggttaagtcccgcaacgagcgcaaccctcgtccttagttgctagcagtttaagctgagcactctaaggagactgccttcgtaaggaggaggaaggtgaggacgacgtcaagtcatcatggcccttacgcctagggctacacacgtgctacaatggggcgcacaaagaggagcaataccgcgaggtggagcaaatctcaaaaacgtctcccagttcggattgtagtctgcaactcgactacataaagctggaatcgctagtaatcgtgaatcagcaatgtcacggtgaatacgttcccgggtcttgtactcaccgcccgtcacaccatgggagttgtattcgccctaagccggaatgctaaattggctaccgtccacggcggatgcagcgactggggtgaagtcgtaacaaggtaaccgtaggtgaacctgcggttggatcacctcctttcta

SEQ ID NO: 4236 - DNA, 1808 bp, Helicobacter sp. CLO3 human
  ref <308>: DATABASE ACCESSION NUMBER: NCBI ACCESSION: NZ_FZRC01000036.1
  ref <309>: DATABASE ENTRY DATE: 2019-04-01
  ref <313>: RELEVANT RESIDUES IN SEQ ID NO: (1)..(1808)
tatggagagtttgatcctggctcagagtgaacgctggcggcgtgcctaatacatgcaagtcgaacgatgaagcttttagcttgctagaagtggattagtggcgcacgggtgagtaacgcatagataacatgcctcatagtctgggatagccactggaaacggtgattaatactggatactccctaagggggaaagtggctcttaatttagaattcatcacttgtatgaaattcgtctttgggcgataaatgcacgagtgcttaaaaaatagtcagtcactaccgattaggtagctccttcctattttctttcacactcgcacatttctcatcccaaatactaaaatttcatcaaactagattttgcaatataaaattctagtatcttgtgatgatttttaaggttgtggtgtaatgaacgaatgagacgcactaagcgtgcgtcgcagtgagtgaatgcgccatctccttaaaaagcgcacaagagacgaattttaaattaagagcttacgctatgagattggtctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagcgcgtaggcgggaagctaagtcagatgtgaaatcctgtggcttaactgcagaactgcatttgaaactggctttctagagtgtgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttgtgaggctttgtccttgcagtaatgcagctaacgcattaagcattccgcctggggagtacggtcgcaagattaaaactcaaaggaatagacggggacccgcacaagcggtggagcatgtggtttaattcgaagatacacgaagaaccttacctaggcttgacattgatagaatccgctagaaatagtggagtgtctagcttgctagaccttgaaaacaggtgctgcacggctgtcgtcagctcgtgtcgtgagatgttgggttaagtcccgcaacgagcgcaaccctcgtccttagttgctagcagttcggctgagcactctaaggagactgccttcgtaaggaggaggaaggtgaggacgacgtcaagtcatcatggcccttacgcctagggctacacacgtgctacaatggggcgcacaaagagaagcaatagcgtgagctggagccaatctctaaaacgcctctcagttcggattgtagtctgcaactcgactacatgaagctggaatcgctagtaatcgtagatcagctatgctacggtgaatacgttcccgggtcttgtactcaccgcccgtcacaccatgggagttgtattcgccttaagtcgggatactaaattggttaccgcccacggcggatgcagcgactggggtgaagtcgtaacaaggtaaccgtaggtgaacctgcggttggatcacctcctttc

SEQ ID NO: 4237 - DNA, 1497 bp, Helicobacter sp. CNRCH 2005 566H
  ref <308>: DATABASE ACCESSION NUMBER: NCBI ACCESSION: NZ_QXJG01000037.1
  ref <309>: DATABASE ENTRY DATE: 2019-04-01
  ref <313>: RELEVANT RESIDUES IN SEQ ID NO: (1)..(1497)
tttttggagagtttgatcctggctcagagtgaacgctggcggcgtgcctaatacatgcaagtcgaacgatgaagctctagcttgctagagtggattagtggcgcacgggtgagtaatgcataggtaacatgccccatagtctgggatagccactagaaatggtgattaataccggatactccttacgagggaaagtttttcgctatgggattggcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagcgcgtaggcgggctagcaagtcagatgtgaaatcctatggcttaaccatagaactgcatttgaaactattagcctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttggggtgcttgtcactccagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatccgctagagatagtggagtgctagcttgctagaacttgaaaacaggtgctgcacggctgtcgtcagctcgtgtcgtgagatgttgggttaagtcccgcaacgagcgcaaccctcgtccttagttgctaacagttaggctgagcactctagggagactgccttcgcaaggaggaggaaggtgaggatgacgtcaagtcatcatggcccttacgcctagggctacacacgtgctacaatggtatgtacaaaaagacgcaataccgcgaggtggagcaaatctttaaaacatatctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagtcggaataccaaactggttactgcccacggcggatgcagcgactggggtgaagtcgtaacaaggtaaccgtaggtgaacctgcggttggatcacctcctttc

SEQ ID NO: 4238 - DNA, 1502 bp, Helicobacter sp. L15
  ref <308>: DATABASE ACCESSION NUMBER: NCBI ACCESSION: NZ_QXQP01000050.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcctagcttgctaggcggattagtggcgcacgggtgagtaacgcatagatgacatgccctttagtttgggatagccactagaaatggtgattaataccaaatactaccctacgggggaaagatttatcgctaaaggattggtctatgtcctatcagcttgttggtgaggtaaaggctcaccaaggctatgacgggtatccggcctgagagggtgaacggacacactggaactgagacacggtccagactcctacgggaggcagcagtagggaatattgctcaatgggcgcaagcctgaagcagcaacgccgcgtggaggatgaaggccttagggttgtaaactccttttgtcagagaagataatgacggtatctgacgaataagcaccggctaactccgtgccagcagccgcggtaatacggagggtgcaagcgttactcggaatcactgggcgtaaagagtgcgtaggcggggttgtaagtcaggtgtgaaatcctatggcttaaccatagaactgcatttgaaactgcaaccctagagtgtgggagaggtaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtcctcccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaatctgctagaaatagcggagtgtctagcttgctagaccctgaaaacaggtgctgcacggctgtcgtcagctcgtgtcgtgagatgttgggttaagtcccgcaacgagcgcaaccctctttcttagttgctaacaggttaagctgagctctctaagaagactgcctgcgtaagcaggaggaaggtgaggacgacgtcaagtcatcatggcccttacgcctagggctacacacgtgctacaatggggcgcacaaagagatgcaatgccgcgaggttgagccaatcttaaaaacgcctctcagttcggattgcaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagcagctactgcccacggcacacacagcgactggggtgaagtcgtaacaaggtaaccgtaggtgaacctgcggttggatcacctcctttct

SEQ ID NO: 4239 - DNA, 1502 bp, Helicobacter sp. L2
  ref <308>: DATABASE ACCESSION NUMBER: NCBI ACCESSION: NZ_QXQT01000053.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcctagcttgctaggcggattagtggcgcacgggtgagtaacgcatagatgacatgccctttagtttgggatagccactagaaatggtgattaataccaaatactaccctatgggggaaagatttatcgctaaaggattggtctatgtcctatcagcttgttggtgaggtaaaggctcaccaaggcgatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgtcagagaagataatgacggtatctgacgaataagcaccggctaactccgtgccagcagccgcggtaatacggagggtgcaagcgttactcggaatcactgggcgtaaagagtgcgtaggcggggttgtaagtcaggtgtgaaatcctatggcttaaccatagaactgcatttgaaactacaaccctagagtgtgggagaggtaggtggaattcttggtgtaggggtaaaatccgtagagatcaagaggaatactcattgcgaaggcgacctgctagaacaatactgacgctgattgcacgaaagcgtggggagcaaacaggattagataccctggtagtccacgccctaaacgatggatgctagttgttggggggctttgtcctcccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaatctgctagaaatagcggagtgtctagcttgctagaccctgaaaacaggtgctgcacggctgtcgtcagctcgtgtcgtgagatgttgggttaagtcccgcaacgagcgcaaccctctttcttagttgctaacaggttacgctgagctctctaagaagactgcctgcgtaagcaggaggaaggtgaggacgacgtcaagtcatcatggcccttacgcctagggctacacacgtgctacaatggggcgcacaaagagatgcaatgccgcgaggttgagctaatcttaaaaacgcctctcagttcggattgcaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagtagctactgcccacggcacacacagcgactggggtgaagtcgtaacaaggtaaccgtaggtgaacctgcggttggatcacctcctttct

SEQ ID NO: 4240 - DNA, 1502 bp, Helicobacter sp. L4
  ref <308>: DATABASE ACCESSION NUMBER: NCBI ACCESSION: NZ_QXQS01000044.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcctagcttgctaggcggattagtggcgcacgggtgagtaacgcatagatgacatgccctttagtttgggatagccactagaaatggtgattaataccaaatactaccctacgggggaaagatttatcgctaaaggattggtctatgtcctatcagcttgttggtgaggtaaaggctcaccaaggctatgacgggtatccggcctgagagggtgaacggacacactggaactgagacacggtccagactcctacgggaggcagcagtagggaatattgctcaatgggcgcaagcctgaagcagcaacgccgcgtggaggatgaaggccttagggttgtaaactccttttgtcagagaagataatgacggtatctgacgaataagcaccggctaactccgtgccagcagccgcggtaatacggagggtgcaagcgttactcggaatcactgggcgtaaagagtgcgtaggcggggttgtaagtcaggtgtgaaatcctatggcttaaccatagaactgcatttgaaactacaaccctagagtgtgggagaggtaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtcctcccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaagggatctgctagaaatagcggagtgcttggcttgccaagccctgaaaacaggtgctgcacggctgtcgtcagctcgtgtcgtgagatgttgggttaagtcccgcaacgagcgcaaccctctttcttagttgctaacaggtcatgctgagctctctaagaagactgcctgcgtaagcaggaggaaggtgaggacgacgtcaagtcatcatggcccttacgcctagggctacacacgtgctacaatggggcgcacaaagagatgcaatgccgcgaggttgagccaatcttaaaaacgcctctcagttcggattgcaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagtagctactgcccacggcacacacagcgactggggtgaagtcgtaacaaggtaaccgtaggtgaacctgcggttggatcacctcctttct

SEQ ID NO: 4241 - DNA, 1507 bp, Helicobacter sp. L8
  ref <308>: DATABASE ACCESSION NUMBER: NCBI ACCESSION: NZ_QXQR01000044.1
  ref <309>: DATABASE ENTRY DATE: 2019-04-01
  ref <313>: RELEVANT RESIDUES IN SEQ ID NO: (1)..(1507)
ttaactttatggagagtttgatcctggctcagagtgaacgctggcggcgtgcctaatacatgcaagtcgaacgatgaagcctagcttgctaggcggattagtggcgcacgggtgagtaacgcatagatgacatgccctttagtttgggatagccactagaaatggtgattaataccaaataccaccctacgggggaaagatttatcgctaaaggattggtctatgtcctatcagcttgttggcggggtaagagcccaccaaggcaatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgtcagagaagataatgacggtatctgacgaataagcaccggctaactccgtgccagcagccgcggtaatacggagggtgcaagcgttactcggaatcactgggcgtaaagagtgcgtaggcggggttgtaagtcagatgtgaaatcctatggcttaaccatagaactgcatttgaaactacaactctggagtgtgggagaggtaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtccccccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaatcccctagaaataggggagtgtctagcttgctagaccctgaaaacaggtgctgcacggctgtcgtcagctcgtgtcgtgagatgttgggttaagtcccgcaacgagcgcaaccctctttcttagttgctaacaggttaagctgagctctctaagaagactgcctgcgtaagcaggaggaaggtgaggacgacgtcaagtcatcatggcccttacgcctagggctacacacgtgctacaatggggtgtacaaagagatgcaatgccgcgaggctgagccaatcttaaaaacatctctcagttcggattgcaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagtagctactgcccacggcacacacagcgactggggtgaagtcgtaacaaggtaaccgtaggtgaacctgcggttggatcacctcctttct

SEQ ID NO: 4242 - DNA, 1502 bp, Helicobacter sp. L9
  ref <308>: DATABASE ACCESSION NUMBER: NCBI ACCESSION: NZ_QXQQ01000050.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcctagcttgctaggtggattagtggcgcacgggtgagtaacgcatagatgacatgccctttagtttgggatagccactagaaatggtgattaataccaaatactaccctacgggggaaagatttatcgctaaaggattggtctatgtcctatcagcttgttggtgaggtaagagcccaccaaggctatgacgggtatccggcctgagagggtgaacggacacactggaactgagacacggtccagactcctacgggaggcagcagtagggaatattgctcaatgggcgcaagcctgaagcagcaacgccgcgtggaggatgaaggttttaggattgtaaactccttttgtcagagaagataatgacggtatctgacgaataagcaccggctaactccgtgccagcagccgcggtaatacggagggtgcaagcgttactcggaatcactgggcgtaaagagtgcgtaggcggggttgtaagtcagatgtgaaatcctatggcttaaccatagaactgcatttgaaactgcgatcctagagtgtgggagaggtaggtggaattcttggtgtaggggtaaaatccgtagagatcaagaggaatactcattgcgaaggcgacctgctggaacaatactgacgctgattgcacgaaagcgtggggagcaaacaggattagataccctggtagtccacgccctaaacgatggatgctagttgttggggggctttgtcctcccagtaatgcagctaacgccttaagcatcccgcctggggagtacggtcgcaagattaaaactcaaaggaatagacggggacccgcacaagcggtggagcatgtggtttaattcgaagatacacgaagaaccttacctaggcttgacattgaaggaatcccctagaaataggggagtgtctagcttgctaggccctgaaaacaggtgctgcacggctgtcgtcagctcgtgtcgtgagatgttgggttaagtcccgcaacgagcgcaaccctctttcttagttgctaacaggtcatgctgagctctctaagaagactgcctgcgtaagcaggaggaaggtgaggacgacgtcaagtcatcatggcccttacgcctagggctacacacgtgctacaatgggatgcacaaagagatgcaatgccgcgaggctgagccaatcttaaaaacatctctcagttcggattgtaggctgcaactcgcctgcatgaagctggaatcgctagtaatcgcaaatcagccatgttgcggtgaatacgttcccgggtcttgtactcaccgcccgtcacaccatgggagttgtgtttgccttaagtcaggatgctaaagtagctactgcccacggcacacacagcgactggggtgaagtcgtaacaaggtaaccgtaggtgaacctgcggttggatcacctcctttct

SEQ ID NO: 4243 - DNA, 1300 bp, Helicobacter sp. MIT 99-10781
  ref <308>: DATABASE ACCESSION NUMBER: NCBI ACCESSION: NZ_NXLM01000054.1
  ref <309>: DATABASE ENTRY DATE: 2019-04-01
  ref <313>: RELEVANT RESIDUES IN SEQ ID NO: (1)..(1300)
cgctatgagattggtctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagtgcgcaggcgggatagcaagtcagatgtgaaatgctaaggcttaaccatagcactgcatttgaaactgctattctagagtgtgggagaggtaggtggaattcttggtgtaggggtaaaatccgtagagatcaagaggaatactcattgcgaaggcgacctactggaacattactgacgctcatgcacgaaagcgtggggagcaaacaggattagataccctggtagtccacgccctaaacgatgaatgctagttgttgccttgcttagacttggcagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatctgctagagatagcggagtgccacttttgtggagcttgaaaacaggtgctgcacggctgtcgtcagctcgtgtcgtgagatgttgggttaagtcccgcaacgagcgcaaccctcgtccttagttgctagcagttcggctgagcactctaaggagactgccttcgtaaggaggaggaaggtgaggacgacgtcaagtcatcatggcccttacgcctagggctacacacgtgctacaatggggtgcacaaagagatgcaatagcgcgagctggagccaatctctaaaacatctctcagttcggattgtagtctgcaactcgactacatgaagctggaatcgctagtaatcgcaaatcagccatgttgcggtgaatacgttcccgggtcttgtactcaccgcccgtcacaccatgggagttgtatttgccttaagtcggaatgctaaactggctaccgcccacggcagatgcagcgactggggtgaagtcgtaacaaggtaaccgtaggtgaacctgcggttggatcacctcctttcta

SEQ ID NO: 4244 - DNA, 1502 bp, Helicobacter sp. house sparrow 1
  ref <308>: DATABASE ACCESSION NUMBER: NCBI ACCESSION: NZ_FZQY01000009.1
  ref <309>: DATABASE ENTRY DATE: 2019-04-01
  ref <313>: RELEVANT RESIDUES IN SEQ ID NO: (1)..(1502)
tttatggagagtttgatcctggctcagagtgaacgctggcggcgtgcctaatacatgcaagtcgaacgatgaagcttttagcttgctaaaagtggattagtggcgcacgggtgagtaatgcataggttatgtgccccatagtctgggatagccactggaaacggtgattaatactagatactccctacgggggaaagtttttcgctatgggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggcgaaagcctgaagcagcaacgccgcgtggaggatgaaggttttaggattgtaaactccttttgttagagaagattatgacggtatctaacgaataagcaccggctaactccgtgccagcagccgcggtaatacggagggtgcaagcgttactcggaatcactgggcgtaaagagcgcgtaggcgggatagtaagtcagatgtgaaatcctgtagcttaactacagaactgcatttgaaactgctattctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttggggtgcttgtcactccagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatcctatagagatatgggagtgtctagtttactagaccttgaaaacaggtgctgcacggctgtcgtcagctcgtgtcgtgagatgttgggttaagtcccgcaacgagcgcaaccctcgtccttagttgctagcagttcggctgagcactctagggagactgccttcgtaaggaggaggaaggtgaggacgacgtcaagtcatcatggcccttacgcctagggctacacacgtgctacaatggggtgtacaaagagacgcaataccgcgaggtggagcaaatctcaaaaacatctctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagccgggatgctaaactggctaccgtccacggcggatgcagcgactggggtgaagtcgtaacaaggtaaccgtaggtgaacctgcggttggatcacctcctttcta

SEQ ID NO: 4245 - DNA, 1507 bp, Helicobacter suis
  ref <308>: DATABASE ACCESSION NUMBER: NCBI ACCESSION: NZ_FZKV01000063.1
  ref <309>: DATABASE ENTRY DATE: 2019-04-01
  ref <313>: RELEVANT RESIDUES IN SEQ ID NO: (1)..(1507)
ttaactttatggagagtttgatcctggctcagagtgaacgctggcggcgtgcctaatacatgcaagtcgaacgatgaagcctagcttgctaggttgattagtggcgcacgggtgagtaatgcatagatgacatgccctttagtttggaatagccactagaaatggtgattaataccaaatactaccttacgagggaaagatttatcgctaaaggattggtctatgtcctatcagcttgttggtgaggtaaaggctcaccaaggctatgacgggtatccggcctgagagggtgagcggacacactggaactgagacacggtccagactcctacgggaggcagcagtagggaatattgctcaatgggggaaaccctgaagcagcaacgccgcgtggaggatgaaggttttaggatcgtaaactccttttgttagagaagataatgacggtatctaacgaataagcaccggctaactccgtgccagcagccgcggtaatacggagggtgcaagcgttactcggaatcactgggcgtaaagagtgcgtaggcgggaggacaagtcaggtgtgaaatcctatggcttaaccatagaactgcatttgaaactatccttctggagtgtgggagaggtaggtggaattcttggtgtaggggtaaaatccgtagagatcaagaggaatactcattgcgaaggcgacctgctggaacatcactgacgctgattgcacgaaagcgtggggagcaaacaggattagataccctggtagtccacgccctaaacgatggatgctagttgttgggaggctttgtctttccagtaatgcagctaacgccttaagcatcccgcctggggagtacggtcgcaagattaaaactcaaaggaatagacggggacccgcacaagcggtggagcatgtggtttaattcgaagctacacgaagaaccttacctaggcttgacattgaaggaattccctagaaataggggagtgtctagcttgctagaccctgaaaacaggtgctgcacggctgtcgtcagctcgtgtcgtgagatgttgggttaagtcccgcaacgagcgcaaccctttttcttagttgctaacaggttatgctgcgcactctaagaagactgcctgcgtaagcaggaggaaggtgaggacgacgtcaagtcatcatggcccttacgcctagggctacacacgtgctacaatggggtgcacaaagagatgcaaagccgcgaggcagagctaatctataaaacacctcctagttcggattgcaggctgcaactcgcctgcatgaagctggaatcgctagtaatcgcaaatcagctatgttgcggtgaatacgttcccgggtcttgtactcaccgcccgtcacaccatgggagttgtgtttgccttaagtcaggatgctaaagcagctactgcccacggcacacacagcgactggggtgaagtcgtaacaaggtaaccgtaggtgaacctgcggttggatcacctcctttct

SEQ ID NO: 4246 - DNA, 1501 bp, Helicobacter trogontum
  ref <308>: DATABASE ACCESSION NUMBER: NCBI ACCESSION: NZ_FZND01000051.1
  ref <309>: DATABASE ENTRY DATE: 2019-04-01
  ref <313>: RELEVANT RESIDUES IN SEQ ID NO: (1)..(1501)
tttatggagagtttgatcctggctcagagtgaacgctggcggcgtgcctaatacatgcaagtcgaacgatgaagcttctagcttgctagaagtggattagtggcgcacgggtgagtaatgcataggtaacatgccctttagtctgggatagccactggaaacggtgattaatactggatactccctatgggggaaagaatttcgctaaaggattggcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgtgagagaagataatgacggtatctcacgaataagcaccggctaactccgtgccagcagccgcggtaatacggagggtgcaagcgttactcggaatcactgggcgtaaagagcgcgtaggcggggtagcaagtcagatgtgaaatcctatggcttaactatagaactgcatttgaaactgttactctagagtatgggagaggtaggtggaattcttggtgtaggggtaaaatccgtagagatcaagaggaatactcattgcgaaggcgacctgctagaacattactgacgctgatgcgcgaaagcgtggggagcaaacaggattagataccctggtagtccacgccctaaacgatgaatgctagttgttggggtgcttgtcactccagtaatgcagctaacgcattaagcattccgcctggggagtacggtcgcaagattaaaactcaaaggaatagacggggacccgcacaagcggtggagcatgtggtttaattcgatgatacgcgaagaaccttacctaggcttgacattgatagaatctgctagagatagcggagtgctggcttgccagagcttgaaaacaggtgctgcacggctgtcgtcagctcgtgtcgtgagatgttgggttaagtcccgcaacgagcgcaaccctcgtccttagttgctaacactttaggtgagcactctaaggagactgccttcgcaaggaggaggaaggtgaggatgacgtcaagtcatcatggcccttacgcctagggctacacacgtgctacaatggtatgtacaaaaagaggcaatagcgcgagctggagcaaatctctaaaacatatctcagttcggattgtagtctgcaactcgactacatgaagctggaatcgctagtaatcgcaaatcagccatgttgcggtgaatacgttcccgggtcttgtactcaccgcccgtcacaccatgggagttgtattcgccttaagtcggaatgccaaactggctaccgcccacggcggatgcagcgactggggtgaagtcgtaacaaggtaaccgtaggtgaacctgcggttggatcacctcctttcta

SEQ ID NO: 4247 - DNA, 1497 bp, Helicobacter valdiviensis
  ref <308>: DATABASE ACCESSION NUMBER: NCBI ACCESSION: NZ_NBIU01000048.1
  ref <309>: DATABASE ENTRY DATE: 2019-04-01
  ref <313>: RELEVANT RESIDUES IN SEQ ID NO: (1)..(1497)
tttttggagagtttgatcctggctcagagtgaacgctggcggcgtgcctaatacatgcaagtcgaacgatgaagctctagcttgctagagtggattagtggcgcacgggtgagtaatgcataggtaacatgccccatagtctgggatagccactagaaatggtgattaataccggatactccttacgagggaaagtttttcgctatgggattggcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagataatgacggtatctaacgaataagcaccggctaactccgtgccagcagccgcggtaatacggagggtgcaagcgttactcggaatcactgggcgtaaagagcgcgtaggcgggctagcaagtcagatgtgaaatcctatagcttaactatagaactgcatttgaaactattagcctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttggggtgcttgtcactccagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatccgctagagatagtggagtgctagcttgctagaacttgaaaacaggtgctgcacggctgtcgtcagctcgtgtcgtgagatgttgggttaagtcccgcaacgagcgcaaccctcgtccttagttgctaacagttaggctgagcactctagggagactgccttcgcaaggaggaggaaggtgaggatgacgtcaagtcatcatggcccttacgcctagggctacacacgtgctacaatggtatgtacaaaaagacgcaataccgcgaggtggagcaaatctttaaaacatatctcagttcggattgtagtctgcaactcgactacatgaagctggaatcgctagtaatcgtgaatcagccatgtcacggtgaatacgttcccgggtcttgtactcaccgcccgtcacaccatgggagttgtattcgccttaagtcggaatactaaattggttactgcccacggcggatgcagcgactggggtgaagtcgtaacaaggtaaccgtaggtgaacctgcggttggatcacctcctttc

SEQ ID NO: 4248 - DNA, 1500 bp, Helicobacter winghamensis
  ref <308>: DATABASE ACCESSION NUMBER: NCBI ACCESSION: NZ_MBPL01000019.1
  ref <309>: DATABASE ENTRY DATE: 2019-04-01
  ref <313>: RELEVANT RESIDUES IN SEQ ID NO: (1)..(1500)
tttatggagagtttgatcctggctcagagtgaacgctggcggcgtgcctaatacatgcaagtcgaacgatgaagcttctagcttgctagaagtggattagtggcgcacgggtgagtaatgcataggttatgtgccctttagtctgggatagccactggaaacggtgattaataccggatattccctacgggggaaaggtttttcgctaaaggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggggaaaccctgaagcagcaacgccgcgtggaggatgaaggttttcggattgtaaactccttttgttagagaagattatgacggtatctaacgaataagcaccggctaactccgtgccagcagccgcggtaatacggagggtgcaagcgttactcggaatcactgggcgtaaagagcgcgtaggcgggataataagtcagatgtgaaatcctatggcttaaccatagaactgcatttgaaactattattctagagtatgggagaggtaggtggaattcttggtgtaggggtaaaatccgtagagatcaagaggaatactcattgcgaaggcgacctgctggaacattactgacgctgatgcgcgaaagcgtggggagcaaacaggattagataccctggtagtccacgccctaaacgatgaatgctagttgttggggtgcttgtcactccagtaatgcagctaacgcattaagcattccgcctggggagtacggtcgcaagattaaaactcaaaggaatagacggggacccgcacaagcggtggagcatgtggtttaattcgaagatacgcgaagaaccttacctaggcttgacattgatagaatccgctagagatagtggagtgctagcttgctagaacttgaaaacaggtgctgcacggctgtcgtcagctcgtgtcgtgagatgttgggttaagtcccgcaacgagcgcaaccctcgtccttagttgctaactattcggtagagcactctaaggagactgccttcgtaaggaggaggaaggtgaggatgacgtcaagtcatcatggcccttacgcctagggctacacacgtgctacaatggtatgtacaaagagaagcaataccgcgaggtggagcaaatctataaaacatatctcagttcggattgtagtctgcaactcgactacatgaagctggaatcgctagtaatcgcaaatcagcaatgttgcggtgaatacgttcccgggtcttgtactcaccgcccgtcacaccatgggagttgtattcgccttaagtcggaatgccaaactggctaccgcccacggcggatgcagcgactggggtgaagtcgtaacaaggtaaccgtaggtgaacctgcggttggatcacctcctttc

SEQ ID NO: 4249 - DNA, 1533 bp, Heliobacterium modesticaldum
  ref <308>: DATABASE ACCESSION NUMBER: NCBI ACCESSION: NC_010337.2
  ref <309>: DATABASE ENTRY DATE: 2019-04-01
  ref <313>: RELEVANT RESIDUES IN SEQ ID NO: (1)..(1533)
atttgtggagagtttgatcctggctcaggacgaacgctggcggcatgcctaacacatgcaagtcgaacggagagctgaagtttcggcggaggctcttagtggcggacgggtgagtaacgcgtggataacctgcctgagagtgggggataacagcccgaaagggctgctaataccgcataacgttcctgaaagacatctttcgggaaccaaaggagcaatccgctgtcagatgggtccgcgtccgattagctagttggcggggtaagagcccaccaaggcgacgatcggtagccggcctgagagggtgaacggccacactgggactgagacacggcccagactcctacgggaggcagcagtggggaatcttccgcaatgggcgaaagcctgacggagcaatgccgcgtgggggacgaaggtcttcggattgtaaaacccttgtcttcagggaagaagaatgacggtacctgaggaggaagccccggctaactacgtgccagcagccgcggtaatacgtagggggcgagcgttgtccggaattactgggcgtaaagcgcgtgcaggcggacctttaagtctgaggtgaaagaccggagctcaactccggggcggccttggaaactggaggtcttgagggatggagaggacagtggaattcccggtgtagcggtgaaatgcgtagatatcgggaggaaccccagtggcgaaggcgactgtctggacattacctgacgctgaggcgcgaaagcgtggggagcaaacaggattagataccctggtagtccacgccgtaaacgatgagtgctaggtgttgggggtatcgacccctccagtgccgcagtcaacacaataagcactccgcctggggagtacggccgcaaggttgaaactcaaaggaattgacgggggcccgcacaagcggtggagcatgtggtttaattcgacgcaacgcgaagaaccttaccaaggcttgacatcctccgaaccttgcagagatgcgagggtgcccttcggggagcggagagacaggtggtgcatggttgtcgtcagctcgtgtcgtgagatgttgggttaagtcccgcaacgagcgcaacccttatcctcagttgccagcgagagagacggggactctggggagactgcccgggacgaccgggaggaaggcggggatgacgtcaaatcatcatgccccttatgtcttgggctacacacgtgctacaatgggcggtacaaaccgaggcgaagccgcgaggcggagcgaaccggagaaagccgctcacagttcggattgctctctgcaactcgagagcatgaaggcggaatcgctagtaatcgcgggtcagcataccgcggtgaatacgttcccgggccttgtacacaccgcccgtcacaccacgaaagtcggcaacacccgaagtcggtgcgctaaccgcaaggaggcagccgccgaaggtggggtcgatgattggggtgaagtcgtaacaaggtagccgtatcggaaggtgcggctggatcacctcctttctatggaga

SEQ ID NO: 4250 - DNA, 1458 bp, Henriciella algicola
  ref <308>: DATABASE ACCESSION NUMBER: NCBI ACCESSION: NZ_QWGA01000008.1
  ref <309>: DATABASE ENTRY DATE: 2019-04-01
  ref <313>: RELEVANT RESIDUES IN SEQ ID NO: (1)..(1458)
caacctgagagtttgattctggctcagaacgaacgctggcggcaggcttaacacatgcaagtcgaacgacatagtggcagacgggtgagtaacgcgtgggaacgtacccttcactacggaatagcttctggaaacggaaggtaataccgtatacgccctccgggggaaagatttatcggtgaaggatcggcccgcgttagattagtttgttggtggggtaatggcctaccaagactacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgccagggatgataatgacagtacctggtaaagaagccccggctaacttcgtgccagcagccgcggtaatacgaagggggctagcgttgttcggaattactgggcgtaaagcgcgcgtaggcgggctattaagccagatgtgaaagcccggggctcaacctcggaattgcatttggaactggtagcctagagaccaggagaggttagcggaataccgagtgtagaggtgaaattcgtagatattcggtggaacaccagtggcgaaggcggctaactggactggtactgacgctgaggcgcgaaagtgtggggagcaaacaggattagataccctggtagtccacaccgtaaacgatgaatgctagttgtctgcgcgcatgcgtgcaggtgacgcagctaacgcattaagcattccgcctggggagtacggccgcaaggttaaaactcaaagaaattgacgggggcccgcacaagcggtggagcatgtggtttaattcgaagcaacgcgcagaaccttacccgcgtttgacatgccctgtttggttaccagagatggtttccttcatttagttggcaggtgcacaggtgctgcatggctgtcgtcagctcgtgtcgtgagatgttgggttaagtcccgcaacgagcgcaacccttatccttagttgccagcacgtttgggtgggcactctaaggaaactgccggtgctaagccggaggaaggcggggatgacgtcaagtcctcatggcccttacacgcggggctacacacgtgctacaatggcagtgacaatgggataatcccaaaaagctgtctcagttcagattgtcctctgcaactcgagggcatgaagttggaatcgctagtaatcgtggatcagcatgccacggtgaatacgttcccgggccttgtacacaccgcccgtcacatcatgggagttggatctacccgaagactgtgcgctaacttcggaggcagcaggccacggtaggttcagcgactgggatgaagtcgtaacaaggtagccgtaggggaacctgcggctggatcacctcctttctaa

SEQ ID NO: 4251 - DNA, 1458 bp, Henriciella aquimarina
  ref <308>: DATABASE ACCESSION NUMBER: NCBI ACCESSION: NZ_NCST01000059.1
  ref <309>: DATABASE ENTRY DATE: 2019-04-01
  ref <313>: RELEVANT RESIDUES IN SEQ ID NO: (1)..(1458)
caacctgagagtttgattctggctcagaacgaacgctggcggcaggcttaacacatgcaagtcgaacgacatagtggcagacgggtgagtaacgcgtgggaacgtgcccttcactacggaatagcttctggaaacggaaggtaataccgtatacgcccttcgggggaaagatttatcggtgaaggatcggcccgcgttgcattagtttgttggtggggtaatggcctaccaagactacgatgcatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgccaaggatgataatgacagtacttggtaaagaagccccggctaacttcgtgccagcagccgcggtaatacgaagggggctagcgttgttcggaattactgggcgtaaagcgcgcgtaggcgggttgttaagccagatgtgaaagcccggggctcaactccggaattgcatttggaactggcaacctagaggccaggagaggttagcggaataccgagtgtagaggtgaaattcgtagatattcggtggaacaccagtggcgaaggcggctaactggactggtactgacgctgaggcgcgaaagtgtggggagcaaacaggattagataccctggtagtccacaccgtaaacgatgaatgctagttgtctgcgcgcatgcgtgcaggtgacgcagctaacgcattaagcattccgcctggggagtacggccgcaaggttaaaactcaaagaaattgacgggggcccgcacaagcggtggagcatgtggtttaattcgaagcaacgcgcagaaccttacccgcgtttgacatgccctgtttggttaccagagatggtttccttcatttagttggcaggtgcacaggtgctgcatggctgtcgtcagctcgtgtcgtgagatgttgggttaagtcccgcaacgagcgcaacccttatccttagttgccagcacgtttgggtgggcactctaaggaaactgccggtgctaagccggaggaaggcggggatgacgtcaagtcctcatggcccttacacgcggggctacacacgtgctacaatggcagtgacaatgggataatcccaaaaaactgtctcagttcggattgtcgtctgcaactcgacggcatgaagttggaatcgctagtaatcgtggatcagcatgccacggtgaatacgttcccgggccttgtacacaccgcccgtcacatcatgggagttggttctacccgaagaccgtgcgctaacttcggaggcagcgggccacggtaggatcagcgactgggatgaagtcgtaacaaggtagccgtaggggaacctgcggctggatcacctcctttctaa

SEQ ID NO: 4252 - DNA, 1458 bp, Henriciella barbarensis
  ref <308>: DATABASE ACCESSION NUMBER: NCBI ACCESSION: NZ_QWGB01000005.1
  ref <309>: DATABASE ENTRY DATE: 2019-04-01
  ref <313>: RELEVANT RESIDUES IN SEQ ID NO: (1)..(1458)
caacctgagagtttgattctggctcagaacgaacgctggcggcaggcttaacacatgcaagtcgaacgacatagtggcagacgggtgagtaacgcgtgggaacgtacccttcactacggaatagcttctggaaacggaaggtaataccgtatacgcccttcgggggaaagatttatcggtgaaggatcggcccgcgttagattagtttgttggtggggtaatggcctaccaagactacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgccagggatgataatgacagtacctggtaaagaagccccggctaacttcgtgccagcagccgcggtaatacgaagggggctagcgttgttcggaattactgggcgtaaagcgcgcgtaggcgggctattaagccagatgtgaaagcccggagctcaactccggaattgcatttggaactggtagcctagagaccaggagaggttagcggaataccgagtgtagaggtgaaattcgtagatattcggtggaacaccagtggcgaaggcggctaactggactggtactgacgctgaggcgcgaaagtgtggggagcaaacaggattagataccctggtagtccacaccgtaaacgatgaatgctagttgtctgtgtgcatgcatacaggtgacgcagctaacgcattaagcattccgcctggggagtacggccgcaaggttaaaactcaaagaaattgacgggggcccgcacaagcggtggagcatgtggtttaattcgaagcaacgcgcagaaccttacccgcgtttgacatgccctgtttggttaccagagatggtttccttcatttggttggcaggtgcacaggtgctgcatggctgtcgtcagctcgtgtcgtgagatgttgggttaagtcccgcaacgagcgcaacccttatccttagttgccagcacgtttgggtgggcactctaaggaaactgccggtgctaagccggaggaaggcggggatgacgtcaagtcctcatggcccttacacgcggggctacacacgtgctacaatggcagtgacaatgggataatcccaaaaagctgtctcagttcagattgtcctctgcaactcgagggcatgaagttggaatcgctagtaatcgtggatcagcatgccacggtgaatacgttcccgggccttgtacacaccgcccgtcacatcatgggagttggatctacccgaagactgtgcgctaacttcggaggcagcaggccacggtaggttcagcgactgggatgaagtcgtaacaaggtagccgtaggggaacctgcggctggatcacctcctttctaa

SEQ ID NO: 4253 - DNA, 1458 bp, Henriciella litoralis
  ref <308>: DATABASE ACCESSION NUMBER: NCBI ACCESSION: NZ_NCSS01000006.1
  ref <309>: DATABASE ENTRY DATE: 2019-04-01
  ref <313>: RELEVANT RESIDUES IN SEQ ID NO: (1)..(1458)
caacctgagagtttgattctggctcagaacgaacgctggcggcaggcttaacacatgcaagtcgaacgatatagtggcagacgggtgagtaacgcgtgggaacgtgcctttcactacggaatagctcttggaaacgagtggtaataccgtatacgccctccgggggaaagatttatcggtgaaagatcggcccgcgttagattagtttgttggtggggtaaaggcctaccaagactacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgctagggatgataatgacagtacctagtaaagaagccccggctaacttcgtgccagcagccgcggtaatacgaagggggctagcgttgttcggaattactgggcgtaaagcgcgcgtaggcgggctattaagtcagatgtgaaagcccggggctcaacctcggaattgcatttgaaactggtagcctagagaccaggagaggttagcggaataccgagtgtagaggtgaaattcgtagatattcggtggaacaccagtggcgaaggcggctaactggactggtactgacgctgaggcgcgaaagtgtggggagcaaacaggattagataccctggtagtccacaccgtaaacgatgaatgctagttgtctgcgcgcatgcgtgcaggtgacgcagctaacgcattaagcattccgcctggggagtacggtcgcaagattaaaactcaaagaaattgacgggggcccgcacaagcggtggagcatgtggtttaattcgaagcaacgcgcagaaccttacccgcgtttgacatgccctgtttggttaccagagatggtttccttcatttagttggcaggtgcacaggtgctgcatggctgtcgtcagctcgtgtcgtgagatgttgggttaagtcccgcaacgagcgcaacccttatccttagttgccagcacgtttgggtgggcactctaaggaaactgccggtgctaagccggaggaaggcggggatgacgtcaagtcctcatggcccttacacgcggggctacacacgtgctacaatggcagtgacaatgggctaatcccaaaaagctgtctcagttcagattgtcctctgcaactcgagggcatgaagttggaatcgctagtaatcgtggatcagcatgccacggtgaatacgttcccgggccttgtacacaccgcccgtcacatcatgggagttggatctacccgaagactgtgcgctaacttcggaggcagcaggccacggtaggttcagcgactgggatgaagtcgtaacaaggtagccgtaggggaacctgcggctggatcacctcctttctaa

SEQ ID NO: 4254 - DNA, 1458 bp, Henriciella marina
  ref <308>: DATABASE ACCESSION NUMBER: NCBI ACCESSION: NZ_AQXT01000002.1
  ref <309>: DATABASE ENTRY DATE: 2019-04-01
  ref <313>: RELEVANT RESIDUES IN SEQ ID NO: (1)..(1458)
caacctgagagtttgattctggctcagaacgaacgctggcggcaggcttaacacatgcaagtcgaacgacatagtggcagacgggtgagtaacgcgtgggaacgtgcctttcactacggaatagcttctggaaacggaaggtaataccgtatacgcccttcgggggaaagatttatcggtgaaagatcggcccgcgttagattagtttgttggtggggtaatggcctaccaagactacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgccagggatgataatgacagtacctggtaaagaagccccggctaacttcgtgccagcagccgcggtaatacgaagggggctagcgttgttcggaattactgggcgtaaagcgcgcgtaggcgggctgttaagccagatgtgaaagcccagagctcaactctggaattgcatttggaactggcagcctagagaccaggagaggttagcggaataccgagtgtagaggtgaaattcgtagatattcggtggaacaccagtggcgaaggcggctaactggactggtactgacgctgaggcgcgaaagtgtggggagcaaacaggattagataccctggtagtccacaccgtaaacgatgaatgctagttgtctgtgtgcatgcatacaggtgacgcagctaacgcattaagcattccgcctggggagtacggccgcaaggttaaaactcaaagaaattgacgggggcccgcacaagcggtggagcatgtggtttaattcgaagcaacgcgcagaaccttacccgcgtttgacatgccctgtttggttaccagagatggtttccttcatttagttggcaggtgcacaggtgctgcatggctgtcgtcagctcgtgtcgtgagatgttgggttaagtcccgcaacgagcgcaacccttatccttagttgccagcacgtttgggtgggcactctaaggaaactgccggtgctaagccggaggaaggcggggatgacgtcaagtcctcatggcccttacacgcggggctacacacgtgctacaatggcagtgacaatgggataatcccaaaaagctgtctcagttcagattgtcctctgcaactcgagggcatgaagttggaatcgctagtaatcgtggatcagcatgccacggtgaatacgttcccgggccttgtacacaccgcccgtcacatcatgggagttggatctacccgaagactgtgcgctaacttcggaggcagcaggccacggtaggttcagcgactgggatgaagtcgtaacaaggtagccgtaggggaacctgcggctggatcacctcctttctaa

SEQ ID NO: 4255 - DNA, 1458 bp, Henriciella sp. JN25
  ref <308>: DATABASE ACCESSION NUMBER: NCBI ACCESSION: NZ_QWFX01000016.1
  ref <309>: DATABASE ENTRY DATE: 2019-04-01
  ref <313>: RELEVANT RESIDUES IN SEQ ID NO: (1)..(1458)
caacctgagagtttgattctggctcagaacgaacgctggcggcaggcttaacacatgcaagtcgaacgacatagtggcagacgggtgagtaacgcgtgggaacgtgccctttactacggaatagcttctggaaacggaaggtaataccgtatacgcccttcgggggaaagatttatcggtgaaggatcggcccgcgttagattagatagttggtggggtaatggcctaccaagtctacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgccagggatgataatgacagtacctggtaaagaagccccggctaacttcgtgccagcagccgcggtaatacgaagggggctagcgttgttcggaattactgggcgtaaagcgcgcgtaggcgggctgttaagtcagatgtgaaagcccggggctcaaccccggaactgcatttgaaactagcagcctagagaccaggagaggttagcggaataccgagtgtagaggtgaaattcgtagatattcggtggaacaccagtggcgaaggcggctaactggactggtactgacgctgaggcgcgaaagtgtggggagcaaacaggattagataccctggtagtccacaccgtaaacgatgaatgctagttgtctgcgcgcatgcgtgcaggtgacgcagctaacgcattaagcattccgcctggggagtacggccgcaaggttaaaactcaaagaaattgacgggggcccgcacaagcggtggagcatgtggtttaattcgaagcaacgcgcagaaccttacccgcgtttgacatgccctgtttggttaccagagatggtttccttcatttagttggcaggtgcacaggtgctgcatggctgtcgtcagctcgtgtcgtgagatgttgggttaagtcccgcaacgagcgcaacccttatccttagttgccagcacgtctgggtgggcactctaaggaaactgccggtgctaagccggaggaaggcggggatgacgtcaagtcctcatggcccttacacgcggggctacacacgtgctacaatggcagtgacaatgggataatccccaaaagctgtctcagttcagattgtcctctgcaactcgagggcatgaagttggaatcgctagtaatcgtggatcagcatgccacggtgaatacgttcccgggccttgtacacaccgcccgtcacatcatgggagttggttctacccgaagactgtgcgctaacttcggaggcagcaggccacggtaggatcagcgactgggatgaagtcgtaacaaggtagccgtaggggaacctgcggctggatcacctcctttctaa

SEQ ID NO: 4256 - DNA, 1458 bp, Henriciella sp. M65; identical to SEQ ID NO: 4255
  ref <308>: DATABASE ACCESSION NUMBER: NCBI ACCESSION: NZ_QWFZ01000017.1
  ref <309>: DATABASE ENTRY DATE: 2019-04-01
  ref <313>: RELEVANT RESIDUES IN SEQ ID NO: (1)..(1458)

SEQ ID NO: 4257 - DNA, 1458 bp, Henriciella sp. M69; identical to SEQ ID NO: 4255
  ref <308>: DATABASE ACCESSION NUMBER: NCBI ACCESSION: NZ_QWFY01000028.1
  ref <309>: DATABASE ENTRY DATE: 2019-04-01
  ref <313>: RELEVANT RESIDUES IN SEQ ID NO: (1)..(1458)

SEQ ID NO: 4258 - DNA, 1495 bp, Hephaestia caeni
  ref <308>: DATABASE ACCESSION NUMBER: NCBI ACCESSION: NZ_QXDC01000003.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagaccttcgggtctagtggcgcacgggtgcgtaacacgtgggaatctgcccttgggttcggaataactcagagaaatttgagctaataccggatgatgacgtaagtccaaagatttatcgcccagggatgagcccgcggaggattagctagttggtggggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagctccggctaactccgtgccagcagccgcggtaatacggagggagctagcgttgttcggaattactgggcgtaaagcgcacgtaggcggctttgcaagttagaggtgaaagcccggggctcaaccccggaatagcctttaaaactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcggggcacttggtgcttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgccggtcgcggatagtggagacactttccttcagttcggctggaccgtgcacaggtgctgcatggctgtcgtcagctcgtgtcgtgagatgttgggttaagtcccgcaacgagcgcaaccctcgcctttagttgccatcatttagttgggcactctagaggaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaag

SEQ ID NO: 4259 - DNA, 1541 bp, Herbaspirillum rubrisubalbicans
  ref <308>: DATABASE ACCESSION NUMBER: NCBI ACCESSION: NZ_CP024996.1
  ref <309>: DATABASE ENTRY DATE: 2019-04-01
  ref <313>: RELEVANT RESIDUES IN SEQ ID NO: (1)..(1541)
agattaaactaaagagtttgatcctggctcagattgaacgctggcggcatgccttacacatgcaagtcgaacggcagcataggagcttgctcctgatggcgagtggcgaacgggtgagtaatatatcggaacgtgccctagagtgggggataactagtcgaaagactagctaataccgcatacgatctaaggatgaaagtgggggatcgcaagacctcatgctcctggagcggccgatatctgattagctagttggtggggtaaaagcctaccaaggcgacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggtggtagctaatatctactactaatgacggtacctgaagaataagcaccggctaactacgtgccagcagccgcggtaatacgtagggtgcaagcgttaatcggaattactgggcgtaaagcgtgcgcaggcggttgtgtaagtcagatgtgaaatccccgggctcaacctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggtcggaatcctgaagagatttgggagtgctcgaaagagaaccggcgcacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtgggtagcctaaccgcaaggagggcgctcaccacggtaggattcgtgactggggtgaagtcgtaacaaggtagccgtatcggaaggtgcggctggatcacctcctttcta

SEQ ID NO: 4260 - DNA, 1542 bp, Herbaspirillum sp. 3R-3a1
  ref <308>: DATABASE ACCESSION NUMBER: NCBI ACCESSION: NZ_QUQN01000010.1
  ref <309>: DATABASE ENTRY DATE: 2019-04-01
  ref <313>: RELEVANT RESIDUES IN SEQ ID NO: (1)..(1542)
agattgaactgaagagtttgatcctggctcagattgaacgctggcggcatgccttacacatgcaagtcgaacggcagcacgggagcttgctcctggtggcgagtggcgaacgggtgagtaatatatcggaacgtgccctagagtgggggataactagtcgaaagattagctaataccgcatacgatctatggatgaaagtgggggatcgcaagacctcatgctcgtggagcggccgatatctgattagctagttggtggggtaaaagctcaccaaggcgacgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacgggtgaggttaatacctttgcctaatgacggtacctgaagaataagcaccggctaactacgtgccagcagccgcggtaatacgtagggtgcaagcgttaatcggaattactgggcgtaaagcgtgcgcaggcggttatgcaagacagatgtgaaatccccgggctcaacctgggaattgcatttgtgactgtatggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaatcctgaagagatttaggagtgctcgaaagagaaccgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttctgccagaagtagttagcctaaccgtaaggagggcgattaccacggcagggttcgtgactggggtgaagtcgtaacaaggtagccgtatcggaaggtgcggctggatcacctcctttctag

SEQ ID NO: 4261 - DNA, 1540 bp, Herbaspirillum sp. K1R23-30
  ref <308>: DATABASE ACCESSION NUMBER: NCBI ACCESSION: NZ_QYUO01000001.1
  ref <309>: DATABASE ENTRY DATE: 2019-04-01
  ref <313>: RELEVANT RESIDUES IN SEQ ID NO: (1)..(1540)
agattgaactgaagagtttgatcctggctcagattgaacgctggcggcatgccttacacatgcaagtcgaacggcagcgcgggagcaatcctggcggcgagtggcgaacgggtgagtaatgtatcggaacgtgccctagagtgggggataactagtcgaaagattagctaataccgcatacgatctaaggatgaaagtgggggaccgcaaggcctcatgctcgtggagcggccgatatctgattagctagttggtagggtaaaagcctaccaaggcgacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggtctgggtgaatatcctgggctaatgacggtacctgaagaataagcaccggctaactacgtgccagcagccgcggtaatacgtagggtgcgagcgttaatcggaattactgggcgtaaagcgtgcgcaggcggttgtgcaagacagatgtgaaatccccgggcttaacctgggaatggcatttgtgactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtcaactagttgtcggggattaatttccttggtaacgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccggcgcacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggctgccaacccgcgagggggagctaatcccagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcctaaccgcaaggagggcgcttaccacggtaggattcgtgactggggtgaagtcgtaacaaggtagccgtatcggaaggtgcggctggatcacctcctttctag

SEQ ID NO: 4262 - DNA, 1540 bp, Herbaspirillum sp. K2R10-39
  ref <308>: DATABASE ACCESSION NUMBER: NCBI ACCESSION: NZ_QYUN01000002.1
  ref <309>: DATABASE ENTRY DATE: 2019-04-01
  ref <313>: RELEVANT RESIDUES IN SEQ ID NO: (1)..(1540)
agattgaactgaagagtttgatcctggctcagattgaacgctggcggcatgccttacacatgcaagtcgaacggcagcgcgggagcaatcctggcggcgagtggcgaacgggtgagtaacatatcggaacgtgccctggagtgggggataaccagtcgaaagactggctaataccgcatacgatctacggatgaaagtgggggatcgcaagacctcatgctcgtggagcggccgatatctgattagctagttggcggggtaagagcccaccaaggcgacgatcagtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcccctgggataatacctcggggggatgacggtaccggaagaataagcaccggctaactacgtgccagcagccgcggtaatacgtagggtgcaagcgttaatcggaattactgggcgtaaagcgtgcgcaggcggttgtgcaagaccgatgtgaaatccccgggcttaacctgggaactgcattggtgactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtcaactagttgtcgggtcttaattgacttggtaacgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtgggtagcctaaccgcaaggagggcgctcaccacggtaggattcgtgactggggtgaagtcgtaacaaggtagccgtatcggaaggtgcggctggatcacctcctttctag

SEQ ID NO: 4263 - DNA, 1541 bp, Herbaspirillum sp. XFZ15 10 5
  ref <308>: DATABASE ACCESSION NUMBER: NCBI ACCESSION: NZ_RBLK01000006.1
  ref <309>: DATABASE ENTRY DATE: 2019-04-01
  ref <313>: RELEVANT RESIDUES IN SEQ ID NO: (1)..(1541)
agattaaactaaagagtttgatcctggctcagattgaacgctggcggcatgccttacacatgcaagtcgaacggcagcataggagcttgctcctgatggcgagtggcgaacgggtgagtaatatatcggaacgtgccctagagtgggggataactagtcgaaagactagctaataccgcatacgatctacggatgaaagtgggggatcgcaagacctcatgctcctggagcggccgatatctgattagctagttggtggggtaaaagcctaccaaggcgacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggtagtagctaatatctactactaatgacggtacctgaagaataagcaccggctaactacgtgccagcagccgcggtaatacgtagggtgcaagcgttaatcggaattactgggcgtaaagcgtgcgcaggcggttgtgtaagtcagatgtgaaatccccgggctcaacctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatcctgaagagatttgggagtgctcgaaagagaaccatcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtgggtagcctaaccgcaaggagggcgctcaccacggtaggattcgtgactggggtgaagtcgtaacaaggtagccgtatcggaaggtgcggctggatcacctcctttcta

SEQ ID NO: 4264 - DNA, 1542 bp, Herbinix hemicellulosilytica
  ref <308>: DATABASE ACCESSION NUMBER: NCBI ACCESSION: NZ_RSDX01000001.1
  ref <309>: DATABASE ENTRY DATE: 2019-04-01
  ref <313>: RELEVANT RESIDUES IN SEQ ID NO: (1)..(1542)
ttaaacatgagagtttgatcctggctcaggatgaacgctggcggcgtgcctaacacatgcaagtcgaacggagttattatcatgaagttttcggatggattgataataacttagtggcggacgggtgagtaacgcgtgggtaacctacctcatactgggggataacagctggaaacggctgctaaaaccgcataagatcgtagtgccgcatggtacagcgattaaatatttcataggtatgagatgggcccgcgtctgattagctagttggtgaggtaatggctcaccaaggcgacgatcagtagccggcttgagagagtgaccggccacattgggactgagacacggcccaaactcctacgggaggcagcagtggggaatattgcacaatgggggaaaccctgatgcagcgacgccgcgtgagtgaagaagtgcttcggcatgtaaagctctatcagcagggaagaagatgacggtacctgactaagaagccccggctaactacgtgccagcagccgcggtaatacgtagggggcaagcgttatccggatttactgggtgtaaagggagcgtaggtggtgcggcaagtcagatgtgaaaacccggggctcaaccccgggactgcatttgaaactgtcgtgctagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtcgggggtcaaaagaccttcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttccctacggggcaacggagacaggtggtgcatggttgtcgtcagctcgtgtcgtgagatgttgggttaagtcccgcaacgagcgcaacccttatccttagtagccagcaggtaaagctgggcactctagggagactgccagggacaacctggaggaaggtggggatgacgtcaaatcatcatgccccttatgatctgggctacacacgtgctacaatggcggccacaaagggaagcgaccctgtgaaggtgagcaaatcccaaaaaagccgtcccagttcggattgtagtctgcaactcgactacatgaagccggaatcgctagtaatcgcgaatcagcatgtcgcggtgaatacgttcccgggtcttgtacacaccgcccgtcacaccatgggagtcggaaatgcccgaagtcagtgacccaacccggtagggagggagctgccgaaggtggagccgatgactggggtgaagtcgtaacaaggtagccgtatcggaaggtgcggctggatcacctcctttctaag

SEQ ID NO: 4265 - DNA, 1542 bp, Herminiimonas sp. KBW02
  ref <308>: DATABASE ACCESSION NUMBER: NCBI ACCESSION: NZ_QAJP01000012.1
  ref <309>: DATABASE ENTRY DATE: 2019-04-01
  ref <313>: RELEVANT RESIDUES IN SEQ ID NO: (1)..(1542)
agattgaactgaagagtttgatcctggctcagattgaacgctggcggcatgccttacacatgcaagtcgaacggcagcacgggtgcttgcacctggtggcgagtggcgaacgggtgagtaatatatcggaacgtaccctagagtgggggataacgcagcgaaagttgcgctaataccgcatacgatctacggatgaaagtgggggatcgcaagacctcatgctcatggagcggccgatatctgattagctagttggtggggtaaaggcctaccaaggcatcgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggtgagggctaatatcctttgctaatgacggtacctgaagaataagcaccggctaactacgtgccagcagccgcggtaatacgtagggtgcaagcgttaatcggaattactgggcgtaaagcgtgcgcaggcggttatgtaagtcagatgtgaaatccccgggctcaacctgggaatggcatttgagactgcatggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtctactagttgtcgggacttaattgtcttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaacctctgagagattagagggtgctcgaaagagagccgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggtttcaccagaagtaggtagcctaaccgcaaggagggcgcttaccacggtgggattcgtgactggggtgaagtcgtaacaaggtagccgtatcggaaggtgcggctggatcacctcctttctag

SEQ ID NO: 4266 - DNA, 1480 bp, Herpetosiphon llansteffanense
  ref <308>: DATABASE ACCESSION NUMBER: NCBI ACCESSION: NZ_PUBZ01000030.1
  ref <309>: DATABASE ENTRY DATE: 2019-04-01
  ref <313>: RELEVANT RESIDUES IN SEQ ID NO: (1)..(1480)
cggcgagtttgatcctggctcaggacgaacgctggcggcgtgcctaatgcatgcaagtcgaacgcattcttcggaatgagtggcgcacggctgaggaacacgtgactaacctaccccggtgtgggggataacgggtcgaaagactcgctaatcccgcatacgatatcctttggataggaaagccgcaaggcgcactgggcgggggtcgcgtcccattaggttgttggtgtggtaatggcgcaccaagccgatgatgggtctctggtctgagaggacgaccagacagattgggactgagacacggcccaaactcctacggggggcagcagcaaggaattttcggcaatgggcgcaagcctgaccgagcaacgccgcgtggaggatgacggctcttgggttgtaaactccttttgggggggacgataatgacggtaccctccgaatcaggcccggctaactacgtgccagcagccgcggtaatacgtaggggccaagcgttgtccggaattactgggcgtaaagcgtgggtaggtggtcggtgatgtgccgcgtgaaagcgccggagtaatgccggcgaggtcgcggtagacacaccgactggaggctcgcagaggaacgtggaattcccggtgtagtggtgaaatgcgtagatatcgggaggaacaccagtggcgcaagcggcgttctgggcgagacctgacactgagccacgacggcgtggggagcaaacaggattagataccctggtagtccacgcagtaaacgatgcataccaggtgtgggatggcgttcgcgtcgttccgtgccgcagcttacgcgatgagtatgccgcctggggactacgagcgcaagcttaaaactcaaaggaattgacgggggcccgcacaagcagcggagcgtgtggtttaattcgacgcaacgcgaagaaccttacctagtcttgacatagcactgcaagcttcggaaatgaagtcgccttcgagggtgtgctacaggtgctgcatggctgtcgtcagctcgtgtcgtgagatgttgggttaagtcccgcaacgagcgcaacccctgtgaggtgttacaagtgtcacctcagactgccgttgtcaacaacggaggaaggcggggatgacgtcaagtccgcatggcccttacgactagggcgacacacacgctacaatggctgggagaatgcgccgcgaccaggtaactggcagcgaatcgagaacaccagtcacagttcagattgggggctgcaactcgcccccatgaaggcggagttgctagtaatcgccggtcagccatacggcggtgaatcagtacccgggccttgtacacaccgcccgtcacgtcatggaagtgggaaacacctgaagtccgtgggctaaccgcaaggaggcagcggccgagggtggggctcgtaactgggacgaagtcgtaacaaggtagccgtaccggaaggtgtggctggatcacctcctttcta

SEQ ID NO: 4267 - DNA, 1437 bp, Hespellia stercorisuis
  ref <308>: DATABASE ACCESSION NUMBER: NCBI ACCESSION: NZ_FQZY01000002.1
  ref <309>: DATABASE ENTRY DATE: 2019-04-01
  ref <313>: RELEVANT RESIDUES IN SEQ ID NO: (1)..(1437)
tttgtgattgagcggcggacgggtgagtaacgcgtggataacctacctcatacagggggataacagttagaaatgactgctaataccgcataagaccgcggcaccgcatggtgcagtggtaaaaactccggtggtatgagatggatccgcgtctgattagctagttggtgaggtaatggcccaccaaggcgacgatcagtagccgacctgagagggtgatcggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagtgtagacggtacggcaagtcagatgtgaaagctcagggctcaaccctggaactgcatttgaaactgtcgaactagagtgtcggagaggtaagtggaattcctagtgtagcggtgaaatgcgtagatattaggaggaacaccagtggcgaaggcgacttactggacgattactgacgttgaggctcgaaagcgtggggagcaaacaggattagataccctggtagtccacgccgtaaacgatgaatactaggtgtcagggagcaaagctctttggtgccgcagcaaacgcattaagtattccacctggggagtacgttcgcaagaatgaaactcaaaggaattgacggggacccgcacaagcggtggagcatgtggtttaattcgaagcaacgcgaagaaccttacctggtcttgacatccttttgaccggtccgtaatgggacctttccttcgggacaagagtgacaggtggtgcatggttgtcgtcagctcgtgtcgtgagatgttgggttaagtcccgcaacgagcgcaacccttatttttagtagccagcatttcggatgggcactctagagagactgccagggataacctggaggaaggtggggatgacgtcaaatcatcatgccccttatgaccagggctacacacgtgctacaatggcgtaaacaaagagaagcaaagtcgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgcaaggagggagctgccgaaggtgggaccgataactggggtgaagtcgtaacaaggtagccgtatcggaaggtgcggctggatcacctcctttctaagga

SEQ ID NO: 4268 - DNA, 497 bp, Hippea alviniae
  ref <308>: DATABASE ACCESSION NUMBER: NCBI ACCESSION: NZ_ATUV01000002.1
  ref <309>: DATABASE ENTRY DATE: 2019-04-01
  ref <313>: RELEVANT RESIDUES IN SEQ ID NO: (1)..(497)
taacatgagagtttgatcctggctcagaacgaacgctggcggcgtgcctaacacatgcaagtcgtgggagaaagtctccttcgggagacgagtaaaccggcgcacgggtgagtaacacgtgggtaacctaccccagagtctgggataacccaccgaaaggtgggctaataccggatagttccctgtctcacaagagacagggggaaagagggcctctgcttgcaagctctcgctctgggatgggcctgcggcctatcaggtagttggtagggtaacggcctaccaagcctacgacgggtagctggtctgagaggatggtcagccacactggcactgagacacgggccagactcctacgggaggcagcagtggggaatattgggcaatgggcgaaagcctgacccagcgacgccgcgtggaggatgaaggccttcgggtcgtaaactcctgtcagaggggaagaaggcagcagggctaatacccctgcttgcttgacg

SEQ ID NO: 4269 - DNA, 1046 bp, Hippea jasoniae
  ref <308>: DATABASE ACCESSION NUMBER: NCBI ACCESSION: NZ_JQLX01000009.1
  ref <309>: DATABASE ENTRY DATE: 2019-04-01
  ref <313>: RELEVANT RESIDUES IN SEQ ID NO: (1)..(1046)
taacatgagagtttgatcctggctcagaacgaacgctggcggcgtgcctaacacatgcaagtcgtgggagaaactctccttcgggagaggagtaaaccggcgcacgggtgagtaacacgtgggtaacctgccctgaagtctgggataacccaccgaaaggtgggctaataccggatagttccctgcctcacaagaggcagggggaaagggggcctctgcttgcaagctctcgcttcaggatgggcccgcggcctatcaggtagttggtggggtaaaagcctaccaagcctacgacgggtagctggtctgagaggatggtcagccacactggcactgagacacgggccagactcctacgggaggcagcagtggggaatattgggcaatgggcgaaagcctgacccagcgacgccgcgtggaggatgaaggccttcgggtcgtaaactcctgtcagaggggaagaaggcatagagggctaatacccctttatgcttgacggtaccctcagaggaagcaccggctaactacgtgccagcagccgcggtaatacgtagggtgcgagcgttgttcggaatcactgggcgtaaagcgtgcgtaggcggccctgtaagtccaatgtgaaagccttgggctcaacccaagaattgcattggatactgcagggctcagagtgcgggagaggcaagcggaattcccggtggaggggtgaaatccgtagatatcgggaggaacaccggtggcgaaggcggcttgctggaacgcaactgacgctgaggcacgaaagcgtggggagcaaacaggattagataccctggtagtccacgccctaaacgatggacgctgggtgtcgggaggtaaccttcccggtgccgtaagctaacgcgttaagcgtcccgcctggggagtacggccgcaaggctaaaactcaaaggaattgacgggggcccgcacaagcggtggagcatgtggtttaattcgatgatacgcgaagaaccttacctgggcttgacatgctggtggtagtgaaccgaaaggggaacgacccc

SEQ ID NO: 4270 - DNA, 1662 bp, Hippea maritima
  ref <308>: DATABASE ACCESSION NUMBER: NCBI ACCESSION: NC_015318.1
  ref <309>: DATABASE ENTRY DATE: 2019-04-01
  ref <313>: RELEVANT RESIDUES IN SEQ ID NO: (1)..(1662)
acatgagagtttgatcctggctcagaacgaacgctggcggcgtgcctaacacatgcaagtcgtgggagaaagtctccttcgggagacgagtaaaccggcgcacgggtgagtaacacgtgggtaacctgccctgaagtccgggataacccaccgaaaggtgggctaataccggatagttcccctgcacttatcttagaatacaagaggatggtagaagaggttatgtgttttgtcctttacctcttttactcttttaattctctgtgttttaagataagtgcaggggggaaaggtggcctctgcttgcaagctatcgcttcaggatgggcccgcggcctatcaggtagttggtggggtaacggcctaccaagcctacgacgggtagctggtctgagaggatggtcagccacactggaactgagacacggtccagactcctacgggaggcagcagtggggaatattgggcaatgggggaaaccctgacccagcgacgccgcgtggaggatgaaggccttcgggtcgtaaactcctgtcagaggggaagaaggtgcgagggctaatacccctttgcacttgacggtaccctcagaggaagcaccggctaactacgtgccagcagccgcggtaatacgtagggtgcgagcgttgttcggaatcactgggcgtaaagcgtgcgtaggcgggcctgtaagtccaacgtgaaagccttgggctcaacccaagaactgcgttggatactgcaggtcttagagtgcgggagaggtgagcggaattcccggtgtaggggtgaaatccgtagatatcgggaagaacaccggtggcgaaggcggctcactggaacgcaactgacgctgaggcacgaaagcgtggggagcaaacaggattagataccctggtagtccacgccctaaacgatggacgctgggtgtcgggaggtactcttcccggtgccgtaagctaacgcgttaagcgtcccgcctggggagtacggccgcaaggctaaaactcaaaggaattgacgggggcccgcacaagcggtggagcatgtggtttaattcgatgatacgcgaagaaccttacctgggcttgacatgctggtggtagtgaaccgaaaggggaacgacccttaccttcgggtgagggagccagcacaggtgctgcatggctgtcgtcagctcgtgtcgtgagatgttgggttaagtcccgcaacgagcgcaaccctcgcccttagttgctaacggttcggccgagcactctaaggggaccgccagggataacctggaggaaggtggggatgacgtcaagtcatcacggcccttatgcccagggctacacacgtgctacaatggggtggacaaagggttgcaaacccgcgagggtgagctaatcccaaaaaccatcccccagttcggattgcagtctgcaactcgactgcatgaagccggaatcgctagtaatcgcaggtcagctacactgcggtgaatacgttcccgggccttgtacacaccgcccgtcacaccatgggagtcgattctaccggaagacggtgggctaaccccttttggggaggcagccgtccatggtagggtcggcgactggggtgaagtcgtaacaaggtagccgtaggagaacctgcggctggatcacctcctttctaagg

SEQ ID NO: 4271 - DNA, 1661 bp, Hippea sp. KM1
  ref <308>: DATABASE ACCESSION NUMBER: NCBI ACCESSION: NZ_JAFP01000001.1
  ref <309>: DATABASE ENTRY DATE: 2019-04-01
  ref <313>: RELEVANT RESIDUES IN SEQ ID NO: (1)..(1661)
taacatgagagtttgatcctggctcagaacgaacgctggcggcgtgcctaacacatgcaagtcgtgggagaaagtctccttcgggagacgagtaaaccggcgcacgggtgagtaacacgtgggtaacctgccctgaagtccgggataacccaccgaaaggtgggctaataccggatagttccctgcctcacaagaggcagggggaaaggtggcctctgcttgcaagctatcgcttcaggatgggcccgcggcctatcaggtagttggtggggtaacggcctaccaagcctacgacgggtagctggtctgagaggatggtcagccacactggcactgagacacgggccagactcctacgggaggcagcagtggggaatattgggcaatgggcgaaagcctgacccagcgacgccgcgtggaggatgaaggccttcgggtcgtaaactcctgtcagaggggaagaaagtgcgagggctaatacccctttgcacttgacggtaccctcagaggaagcaccggctaactacgtgccagcagccgcggtaatacgtagggtgcaagcgttgttcggaatcactgggcgtaaagcgtgcgtaggcgggcctgtaagtccaacgtgaaagccttgggctcaacccaagaactgcgttggatactgcaggtcttagagtgcgggagaggtgagcggaattcccggtgtaggggtgaaatccgtagatatcgggaagaacaccggtggcgaaggcggctcactggaacgcaactgacgctgaggcacgaaagcgtggggagcaaacaggattagataccctggtagtccacgccctaaacgatggacgctgggtgtcgggaggtactcttcccggtgccgtaagctaacgcgttaagcgtcccgcctggggagtacggccgcaaggctaaaactcaaaggaattgacgggggcccgcacaagcggtggagcatgtggtttaattcgatgatacgcgaagaaccttacctgggcttgacatgctggtggtagtgaaccgaaaggggaacgaccctgcacccatttgattgtatggacttaagttcatcttaaagatttatctgtcgtgatgaacagggatagggaacatgaagtctgtgcaatgaaatgggtgcagggagccagcacaggtgctgcatggctgtcgtcagctcgtgtcgtgagatgttgggttaagtcccgcaacgagcgcaaccctcgcccttagttgctaacggttcggccgagcactctaaggggaccgccagggacaacctggaggaaggtggggatgacgtcaagtcatcacggcccttatgcccagggctacacacgtgctacaatggggtggacaaagggctgcgaacccgcgagggggagctaatcccaaaaaccaccccccagttcggattgcagtctgcaactcgactgcatgaagccggaatcgctagtaatcgcaggtcagctacactgcggtgaatacgttcccgggccttgtacacaccgcccgtcacaccatgggagtcgattctaccggaagacggtgggctaaccccttttggggaggcagccgtccatggtagggtcggcgactggggtgaagtcgtaacaaggtagccgtaggagaacctgcggctggatcacctcctttct

SEQ ID NO: 4272 - DNA, 1456 bp, Hirschia baltica
  ref <308>: DATABASE ACCESSION NUMBER: NCBI ACCESSION: NC_012982.1
  ref <309>: DATABASE ENTRY DATE: 2019-04-01
  ref <313>: RELEVANT RESIDUES IN SEQ ID NO: (1)..(1456)
tcaacttgagagtttgattctggctcagaacgaacgctggcggcaggcttaacacatgcaagtcgaacgcactcttcggagtgagtggcagacgggtgagtaacgcgtggaaacgtgcctttctctacggaatagcccttggaaacgaggtgtaataccgtatacgcccttagggggaaagatttatcggagaaagatcggtccgcgttagattagtttgttggtggggtaatggcctaccaagactacgatctatagctgatttgagaggatgatcagccacactggaactgagacacggtccagactcctacgggaggcagcagtggggaatcttggacaatgggggaaaccctgatccagccatgccgcgtgaatgatgaaggccttagggttgtaaaattctttcaccggggaagataatgacggtacccggagaagaagctccggctaacttcgtgccagcagccgcggtaatacgaagggagctagcgttgttcggaattactgggcgtaaagcgcacgtaggcggattagtaagtaagaggtgaaatcccagggctcaaccctggaactgccttttaaactgctagtctagaggataggagaggtcagtggaataccgagtgtagaggtgaaattcgtagatattcggtggaacaccagtggcgaaggcgactgactggactatttctgacgctgaggtgcgaaagtgtggggagcaaacaggattagataccctggtagtccacaccgtaaacgatgagagctagttgtcagcaagcatgcttgttggtgacgcagctaacgcattaagctctccgcctggggagtacggtcgcaagattaaaactcaaagaaattgacgggggcccgcacaagcggtggagcatgtggtttaattcgaagcaacgcgcagaaccttacccacctttgacatcctatgctcactccagagatggagttttcttcggacatagtgacaggtgctgcatggctgtcgtcagctcgtgtcgtgagatgttgggttaagtcccgcaacgagcgcaacccttatctctagttgccagcatttagttgggcactctagagagactgcccgagtcaatcgggaggaaggcggggatgacgtcaagtcctcatggcccttacaggtggggctacacacgtgctacaatggcagtgacaatgggataatcccaaaaagctgtctcagttcggattgttctctgcaactcgagaacatgaagttggaatcgctagtaatcgtggatcagcatgccacggtgaatacgttcccgggccttgtacacaccgcccgtcacaccatgggagttggttctacccgaaggcgctgcgctaatttggcaggcgaccacggtagggtcagcgactggggtgaagtcgtaacaaggtagccgtaggggaacctgcggctggatcacctcctttctaa

SEQ ID NO: 4273 - DNA, 1456 bp, Hirschia maritima
  ref <308>: DATABASE ACCESSION NUMBER: NCBI ACCESSION: NZ_KB899546.1
  ref <309>: DATABASE ENTRY DATE: 2019-04-01
  ref <313>: RELEVANT RESIDUES IN SEQ ID NO: (1)..(1456)
tcaacttgagagtttgattctggctcagaacgaacgctggcggcaggcttaacacatgcaagtcgaacgacctcttcggagggagtggcagacgggtgagtaacgcgtggaaacgtgccctttactacggaatagcccttggaaacgaggtgtaataccgtatacgcccttagggggaaagatttatcggtaaaggatcggtccgcgttagattagtttgttggtggggtaatggcctaccaagactacgatctatagctgatttgagaggatgatcagccacactggaactgagacacggtccagactcctacgggaggcagcagtggggaatcttggacaatgggggaaaccctgatccagccatgccgcgtgaatgatgaaggccttagggttgtaaaattctttcaccggggaagataatgacggtacccggagaagaagctccggctaacttcgtgccagcagccgcggtaatacgaagggagctagcgttgttcggaattactgggcgtaaagcgcacgtaggcggattggaaagttagaggtgaaatcccggggctcaaccccggaactgcctttaaaactcccagtctagaggataggagaggtcagtggaataccgagtgtagaggtgaaattcgtagatattcggtggaacaccagtggcgaaggcgactgactggactatttctgacgctgaggtgcgaaagtgtggggagcaaacaggattagataccctggtagtccacaccgtaaacgatgagagctagttgtcagcaagcatgcttgttggtgacgcagctaacgcattaagctctccgcctggggagtacggtcgcaagattaaaactcaaagaaattgacgggggcccgcacaagcggtggagcatgtggtttaattcgaagcaacgcgcagaaccttacccacctttgacatcctgtgacagctccagagatggagttttcttcggacacagtgacaggtgctgcatggctgtcgtcagctcgtgtcgtgagatgttgggttaagtcccgcaacgagcgcaacccttatctttagttgccagcatttagttgggcactctagagagactgcccgagtcaatcgggaggaaggcggggatgacgtcaagtcctcatggcccttacaggtggggctacacacgtgctacaatggcagtgacaatgggataatccccaaaagctgtctcagttcggattgtcttctgcaactcgaagacatgaagttggaatcgctagtaatcgtggatcagcatgccacggtgaatacgttcccgggccttgtacacaccgcccgtcacaccatgggagttggttctacccgaaggcgctgcgctaatttggcaggcgaccacggtaggatcagcgactggggtgaagtcgtaacaaggtagccgtaggggaacctgcggctggatcacctcctttctaa

SEQ ID NO: 4274 - DNA, 1495 bp, Hoeflea halophila
  ref <308>: DATABASE ACCESSION NUMBER: NCBI ACCESSION: NZ_OCPC01000011.1
  ref <309>: DATABASE ENTRY DATE: 2019-04-01
  ref <313>: RELEVANT RESIDUES IN SEQ ID NO: (1)..(1495)
tcaacttgagagtttgatcctggctcagaacgaacgctggcggcaggcttaacacatgcaagtcgagcgcactcttcggagtgagcggcagacgggtgagtaacgcgtgggaatctacccatctctacggaataactcagggaaacttgtgctaataccgtatacgcccttcgggggaaagatttatcggagatggatgagcccgcgtttgattagctagttggtggggtaaaggcctaccaaggcgacgatcaatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatcgttaagtgaggggtgaaatcccagggctcaaccctggaactgcctttcatactggcgatcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggtttagagagatctattccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacggcaacgtcgagctaatctccaaaaaccatctcagttcggattggggtctgcaactcgaccccatgaagttggaatcgctagtaatcgcggatcagcatgccgcggtgaatacgttcccgggccttgtacacaccgcccgtcacaccatgggagttggttctacccgaaggcgatgcgctaacccgcaagggaggcagtcgaccacggtagggtcagcgactggggtgaagtcgtaacaaggtagccgtaggggaacctgcggctggatcacctcctttctaag

SEQ ID NO: 4275 - DNA, 1493 bp, Hoeflea marina
  ref <308>: DATABASE ACCESSION NUMBER: NCBI ACCESSION: NZ_QGTR01000016.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgaacgccccgcaaggggagtggcagacgggtgagtaacgcgtgggaatctacccatctctacggaacaacagttggaaacgactgctaataccgtatacgccctacgggggaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcgttaagtgaggggtgaaatcccagggctcaaccctggaactgcctttcatactggcgatcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggacagtggagacattgtccttcagttcggctggaccggtgacaggtgctgcatggctgtcgtcagctcgtgtcgtgagatgttgggttaagtcccgcaacgagcgcaaccttcgcccttagttgccagcattcagttgggcactctagggggactgccggtgataagccgcgaggaaggtgaagatgacgtcaagtcctcatggcccttacgggctgggctacacacgtgctacaatggtggtgacagtgggcagcgagacggcaacgtcgagctaatctccaaaaaccatctcagttcggattggggtctgcaactcgaccccatgaagttggaatcgctagtaatcgcggatcagcatgccgcggtgaatacgttcccgggccttgtacacaccgcccgtcacaccatgggagttggttttacccgaaggcgatgcgctaacccgcaagggaggcagtcgaccacggtagggtcagcgactggggtgaagtcgtaacaaggtagccgtaggggaacctgcggctggatcacctcctttctaag

SEQ ID NO: 4276 - DNA, 1494 bp, Hoeflea olei
  ref <308>: DATABASE ACCESSION NUMBER: NCBI ACCESSION: NZ_LQZT01000024.1
  ref <309>: DATABASE ENTRY DATE: 2019-04-01
  ref <313>: RELEVANT RESIDUES IN SEQ ID NO: (1)..(1494)
tcaacttgagagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcgttaagtgaggggtgaaatcccagggctcaaccctggaactgcctttcatactggcgatcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggtctccagagatggagactttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacggcaacgtcgagctaatctccaaaaaccatctcagttcggattggggtctgcaactcgaccccatgaagttggaatcgctagtaatcgcggatcagcatgccgcggtgaatacgttcccgggccttgtacacaccgcccgtcacaccatgggagttggttctacccgaaggcgatgcgctaacccgcaagggaggcagtcgaccacggtagggtcagcgactggggtgaagtcgtaacaaggtagccgtaggggaacctgcggctggatcacctcctttctaagg

SEQ ID NO: 4277 - DNA, 1494 bp, Hoeflea phototrophica
  ref <308>: DATABASE ACCESSION NUMBER: NCBI ACCESSION: NZ_CM002917.1
  ref <309>: DATABASE ENTRY DATE: 2019-04-01
  ref <313>: RELEVANT RESIDUES IN SEQ ID NO: (1)..(1494)
tcaacttgagagtttgatcctggctcagaacgaacgctggcggcaggcttaacacatgcaagtcgaacggtctcttcggaggcagtggcagacgggtgagtaacgcgtgggaatctacccatctctacggaacaacagttggaaacgactgctaataccgtatacgcccttcgggggaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgtgtgatgaaggccctagggttgtaaagcactttcaacggtgaagataatgacggtaaccgtagaagaagccccggctaacttcgtgccagcagccgcggtaatacgaagggggctagcgttgttcggaattactgggcgtaaagcgcacgtaggcggatcgttaagtgaggggtgaaatcccagggctcaaccctggaactgcctttcatactggcgatcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggacagtggagacattgtccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacggcaacgtcgagctaatctccaaaaaccatctcagttcggattggggtctgcaactcgaccccatgaagttggaatcgctagtaatcgcggatcagcatgccgcggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccgtaggggaacctgcggctggatcacctcctttctaagg

SEQ ID NO: 4278 - DNA, 1490 bp, Hoeflea sp. 108
  ref <308>: DATABASE ACCESSION NUMBER: NCBI ACCESSION: NZ_KB890024.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagttagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatatttaagttaggggtgaaatcccagggctcaaccctggaactgcctctaatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggatcccttcagttcggctggaccggtgacaggtgctgcatggctgtcgtcagctcgtgtcgtgagatgttgggttaagtcccgcaacgagcgcaaccttcgcccttagttgccatcattaagttgggcactctaaggggactgccggtgataagccgcgaggaaggtgaagatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 4279 - DNA, 1494 bp, Hoeflea sp. BAL378
  ref <308>: DATABASE ACCESSION NUMBER: NCBI ACCESSION: NZ_JRJG01000181.1
  ref <309>: DATABASE ENTRY DATE: 2019-04-01
  ref <313>: RELEVANT RESIDUES IN SEQ ID NO: (1)..(1494)
tcaacttgagagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcgttaagtgaggggtgaaatcccagggctcaaccctggaactgcctttcatactggcgatcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacggcaacgtcgagctaatctccaaaaaccatctcagttcggattggggtctgcaactcgaccccatgaagttggaatcgctagtaatcgcggatcagcatgccgcggtgaatacgttcccgggccttgtacacaccgcccgtcacaccatgggagttggttctacccgaaggcgatgcgctaacccgcaagggaggcagtcgaccacggtagggtcagcgactggggtgaagtcgtaacaaggtagccgtaggggaacctgcggctggatcacctcctttctaagg

SEQ ID NO: 4280 - DNA, 1495 bp, Hoeflea sp. IMCC20628
  ref <308>: DATABASE ACCESSION NUMBER: NCBI ACCESSION: NZ_CP011479.1
  ref <309>: DATABASE ENTRY DATE: 2019-04-01
  ref <313>: RELEVANT RESIDUES IN SEQ ID NO: (1)..(1495)
tcaacttgagagtttgatcctggctcagaacgaacgctggcggcaggcttaacacatgcaagtcgagcgcctcgcaagaggagcggcagacgggtgagtaacgcgtgggaatctacccatctctacggaacaacagttggaaacgactgctaataccgtatacgcccttcgggggaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgaagaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcgttaagtgaggggtgaaatcccagggctcaaccctggaactgcctttcatactggcgatcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacggggggcccgcacaagcggtgtgagcatgtggtttaattcgaagcaacgcgcagaaccttaccagcccttgacatcccgatcgcggtttccagagatggattccttcagttcggctggatcggtgacaggtgctgcatggctgtcgtcagctcgtgtcgtgacgatgttggttaagtcccgcaacgagcgcaaccttcgcccttagttgccagcattaagttgggcactctaaggggactgccggtgataagccgcgaggaaggtgaagatgacgtcaagtcctcatggcccttacgggctgggctacacacgtgctacaatggtggtgacagtgggcagcgagacggcaacgtcgagctaatctccaaaaaccatctcagttcggattggggtctgcaactcgaccccatgaagttggaatcgctagtaatcgcggatcagcatgccgcggtgaatacgttcccggccttgtacacaccgcccgtcacaccatgggagttggttctacccgaaggcgatgcgctaacccgcaagggaggcagtcgaccacggtagggtcagcgactggggtgaagtcgtaacaaggtagccgtaggggaacctgcggctggatcacctcctttctaagg

SEQ ID NO: 4281 - DNA, 1549 bp, Holdemanella biformis
  ref <308>: DATABASE ACCESSION NUMBER: NCBI ACCESSION: NZ_QSGD01000002.1
  ref <309>: DATABASE ENTRY DATE: 2019-04-01
  ref <313>: RELEVANT RESIDUES IN SEQ ID NO: (1)..(1549)
caaatggagagtttgatcctggctcaggatgaacgctggcggcatgcctaatacatgcaagtcgaacgagaggaaggaaagcttgcttttctgaatctagtggcgaacgggtgagtaacacgtaggtaacctgcccatgtgcccgggataacttctggaaacggatgctaaaaccggataggtagcagacaagcatttgactgctattaaagtggctaaggccatgaacatggatggacctgcggtgcattagctagttggtgaggtaacggcccaccaaggcgacgatgcatagccggcctgagagggcggacggccacattgggactgagacacggcccaaactcctacgggaggcagcagtagggaattttcgtcaatggggggaaccctgaacgagcaatgccgcgtgagtgaggaaggtcttcggatcgtaaagctctgttgtaagagaaaaacgacattcatagggaatgatgagtgagtgatggtatcttaccagaaagtcacggctaactacgtgccagcagccgcggtaatacgtaggtggcgagcgttatccggaatgattgggcgtaaagggtgcgtaggtggcagaacaagtctggagtaaaaggtatgggctcaacccgtactggctctggaaactgttcagctagagaacagaagaggacggcggaactccatgtgtagcggtaaaatgcgtagatatatggaagaacaccggtggcgaaggcggccgtctggtctgttgctgacactgaagcacgaaagcgtggggagcaaataggattagataccctagtagtccacgccgtaaacgatgagaactaggtgttgggggaataactcagtgccgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatcccttgcagaggtatagagatatatccgaggttaacaaggagacaggtggtgcatggttgtcgtcagctcgtgtcgtgagatgttgggttaagtcccgcaacgagcgcaacccttgtgatatgttactaacattgagttgaggactcatatcagactgccggtgataaaccggaggaaggtggggatgacgtcaaatcatcatgccccttatggcctgggctacacacgtactacaatggcgtctacaaagagcggcaagcctgtgaaggcaagcgaatctcataaaggacgtctcagttcggattgaagtctgcaacccgacttcatgaagctggaatcgctagtaatcgcgaatcagcatgtcgcggtgaatacgttctcgggccttgtacacaccgcccgtcaaaccatgggagttggtaatgcccgaagccggtggcataacctttcgaggagtgagccgtcgaaggcaggaccgatgactggggttaagtcgtaacaaggtatccctacgggaacgtggggatggatcacctcctttctaaggaga

SEQ ID NO: 4282 - DNA, 1547 bp, Holdemania filiformis
  ref <308>: DATABASE ACCESSION NUMBER: NCBI ACCESSION: NZ_QRUP01000033.1
  ref <309>: DATABASE ENTRY DATE: 2019-04-01
  ref <313>: RELEVANT RESIDUES IN SEQ ID NO: (1)..(1547)
caaatggagagtttgatcctggctcaggatgaacgctggcggcgtgcctaatacatgcaagtcgaacgctttgtaaaggagcttgcttctttacagggagtggcgaacgggtgagtaatacataagcaatctgcccatcggcctgggataacagttggaaacgactgctaataccggataggtgattgagaggcatctctcgatcattaaagttgggatacaacacggatggatgagcttatggcgtattagctagtaggtgaggtaacggcccacctaggcgatgatacgtagccgacctgagagggtgaccggccacattgggactgagacacggcccaaactcctacgggaggcagcagtagggaattttcggcaatgggcgaaagcctgaccgagcaacgccgcgtgagtgaagaaggccttcgggttgtaaagctctgttgtgaaggaagaacggctcatacagggaatggtatgggagtgacggtactttaccagaaagccacggctaactacgtgccagcagccgcggtaatacgtaggtggcgagcgttatccggaattattgggcgtaaagggtgcgcaggcggtttgttaagtttaaggtgaaagcgtggggcttaaccccatatagccttagaaactgacagactagagtacaggagagggcaatggaattccatgtgtagcggtaaaatgcgtagatatatggaggaacaccagtggcgaaggcggttgcctggcctgtaactgacgctcatgcacgaaagcgtggggagcaaataggattagataccctagtagtccacgccgtaaacgatgagaactaagtgttggggaaactcagtgctgcagttaacgcaataagttctccgcctggggagtatgcacgcaagtgtgaaactcaaaggaattgacgggggcccgcacaagcggtggagtatgtggtttaattcgacgcaacgcgaagaaccttaccaggtcttgacatcccctgcaaagctatggagacatagtggaggttatcagggagacaggtggtgcatggttgtcgtcagctcgtgtcgtgagatgttgggttaagtcccgcaacgagcgcaacccttgtctttagttactaacattaagttgaggactctagagagactgccggtgacaaaccggaggaaggtggggatgacgtcaaatcatcatgccccttatgacctgggctacacacgtactacaatggcggatacaacgagaagcaagacagtgatgtggagcaaaactcagaaagtccgtctcagttcggattgaagtctgcaacccgacttcatgaagccggaatcgctagtaatcgcggatcagcatgccgcggtgaatacgttctcgggccttgtacacaccgcccgtcaaaccatgagagttggcaatacccgaagccggtggcctaacctcgcaagaggagggagccgtcgaaggtagggctgatgattggggttaagtcgtaacaaggtatccctacgggaacgtggggatggatcacctcctttctaaggaga

SEQ ID NO: 4283 - DNA, 1492 bp, Holospora curviuscula
  ref <308>: DATABASE ACCESSION NUMBER: NCBI ACCESSION: NZ_PHHC01000107.1
  ref <309>: DATABASE ENTRY DATE: 2019-04-01
  ref <313>: RELEVANT RESIDUES IN SEQ ID NO: (1)..(1492)
aaacatgagagtttgatcctggctcagaacgaacgctggcggcatgcttaacacatgcaagtcaaacgggaggtagcaataccttcagtggcaaacgggtgagtaacgcgtgggaatctgccttttggagggggacaaccgagggaaaccttggctaataccgcatacacttagaaataagaaaagatttatcgccaaaagatgagcccgcgtcagattaggtagttggtggggtaaaagcctaccaagcctacgatctgtagctggtctgagaggatgatcagccacactgggattgagatacggcccagactcctacgggaggcagcagtgaggaatattggacaatgggggaaaccctgatccagcaatgccgcgtgaatgaagaaggccttcgggtcgtaaagttcttttactcgtgaagatgatgacggtaacgagagaaaaagccccggctaactctgtgccagcagccgcggtaatacagagggggctagcgttgttcggaataactgggcgtaaagggtacgtaggttgttttttaagtgagatgttaaatacccaggcttaacctggggggtgcgtctcaaactggaagactagagtgtggtagaggaaagtggaattcctagtgtagaggtgaaattcgtagatattaggaggaacaccagaggcgaaggcgactttctgggccataactgacactgaggtacgaaagcgtggggagcaaacaggattagataccctggtagtccacgccctaaacgatgagtgctagacgtcgacttttgggttggtgtcgcagctaacgcattaagcactccgcctgaggactacgatcgcaagattaaaacttaaaggaattgacgggggcccgcacaagcggtggagcatgtggtttaattcgtcaacacgcgaaaaaccttaccagctcttgacatgggagtcatcggttctagagatagaactttcggttcggccggactccacacaggtgctgcatggctgtcgtcagctcgtgtcgtgagatattgggttaagtcccgcaacgagcgcaacccttgtccttatttgctaacaggttatgctgaggactataaggagactgccggtgataaatcggaggaaggagaggatgacgtcaggtcctcatggcccttatgggctgggctacacacgtgctacaatggtgacgacaaaaggatgcgacggggtgaccctgagcaaatccctaaacgtcatctcagttcggattgttctctgcaactcgagaacatgaagttggaatcgctagtaatcgtggatcagcacgccacggtgaatacgttcacgggccttgtacacaccgcccgtcaagccatgggagttggtcccacctgaaaccagtgagctaaccgaaaggaggcagctgactatggtggggtcgatgactggggttaagtcgtaacaaggtagccgtaggggaacctgcggctggatcacctcctttcta

SEQ ID NO: 4284 - DNA, 1493 bp, Holospora elegans
  ref <308>: DATABASE ACCESSION NUMBER: NCBI ACCESSION: NZ_BAUP01000039.1
  ref <309>: DATABASE ENTRY DATE: 2019-04-01
  ref <313>: RELEVANT RESIDUES IN SEQ ID NO: (1)..(1493)
aaacatgagagtttgatcctggctcagaacgaacgctggcggcatgcttaacacatgcaagtcaaacgagaggcagcaatgtctctagtggcaaacgggtgagtaacgcgtgggaatctgccttttggagggggacaaccgagggaaaccttggctaataccgcatatacttagaaataagaaaagatttatcgccaaaagatgagcccgcgtcagattaggtagttggtggggtaaaggcctaccaagcctacgatctgtagctggtctgagaggatgatcagccacactgggattgagatacggcccagactcctacgggaggcagcagtgaggaatattggacaatgggggaaaccctgatccagcaatgccgcgtgaatgaagaaggccttcgggtcgtaaaattcttttactcgtgaagatgatgacggtaacgagagaaaaagccccggctaactctgtgccagcagccgcggtaatacagagggggctagcgttgttcggaataactgggcgtaaagggtgcgtaggtggttttttaagtgagatgttaaatacccgggcttaacctggggggtgcgtttcaaactggaagactagagtgcggtagaggaaagtggaattcctagtgtagaggtgaaattcgtagatattaggaggaacatcagaggcgaaagcgactttctggtccgtaactgacactgaggcacgaaagcgtggggagcaaacaggattagataccctggtagtccacgccctaaacgatgagtgctagacgtcagctttataagttggtgtcgcagctaacgcattaagcactccgcctgaggactacgatcgcaagattaaaacttaaaggaattgacgggggcccgcacaagcggtggagcatgtggtttaattcgtcaacacgcgaagaaccttaccagctcttgacatgggagttaccgattctagagatagaatcttcggttcggccggactccacacaggtgctgcatggctgtcgtcagctcgtgtcgtgagatattgggttaagtcccgcaacgagcgcaacccttgtccttatttgctaacaggtaatgctgaggactataaggagactgccggtgataaatcggaggaaggagaggatgacgtcaggtcctcatggcccttatgggctgggctacacacgtgctacaatggtggcgacaaagggaagcaacggggagaccctgagcaaatcctaaaacgtcatctcagttcggattgttctctgcaactcgagaacatgaagttggaatcgctagtaatcgtggatcagcacgccacggtgaatacgttcacgggccttgtacacaccgcccgtcaagccatgggagttgattctacctgaaaccagtgagctaaccgaaaggaggcagctgactatggtggggttgatgactggggttaagtcgtaacaaggtagccgtaggggaacctgcggctggatcacctcctttcta

SEQ ID NO: 4285 - DNA, 1492 bp, Holospora obtusa
  ref <308>: DATABASE ACCESSION NUMBER: NCBI ACCESSION: NZ_AWTR02000005.1
  ref <309>: DATABASE ENTRY DATE: 2019-04-01
  ref <313>: RELEVANT RESIDUES IN SEQ ID NO: (1)..(1492)
aaacatgagagtttgatcctggctcagaacgaacgctggcggcatgcttaacacatgcaagtcaaacgggaggcagcaatgtctccagtggcaaacgggtgagtaacgcgtgggaatctgccttttggagggggacaaccgagggaaaccttggctaataccgcatatacttagaaataaggaaagaatttcgccagaagatgagcccgcgtcagattaggtagttggtggggtaaaggcctaccaagcctacgatctgtagctggtctgagaggatgatcagccacactgggattgagatacggcccagactcctacgggaggcagcagtgaggaatattggacaatgggggaaaccctgatccagcaatgccgcgtgaatgaagaaggccttcgggtcgtaaaattcttttactcgtgaagatgatgacggtaacgagagaaaaagccccggctaactctgtgccagcagccgcggtaatacagagggggctagcgttgttcggaataactgggcgtaaagggtgcgtaggtggttttttaagtgagatgttaaatactcgggcttaacctggggagtgcgtttcaaactggaagactagagtacggtagaggaaagtggaattcctagtgtagaggtgaaattcgtagatattaggaggaacatcagaggcgaaagcggctttctggtccgtaactgacactgaggcacgaaagcgtggggagcaaacaggattagataccctggtagtccacgccctaaacgatgagtgctagacgtcagctttataagttggtgtcgcagctaacgcattaagcactccgcctgaggactacgatcgcaagattaaaacttaaaggaattgacgggggcccgcacaagcggtggagcatgtggtttaattcgtcaacacgcgaagaaccttaccagcccttgacatgggagtcaacgatcttagagataagattttcggttcggccggactccacacaggtgctgcatggctgtcgtcagctcgtgtcgtgagatattgggttaagtcccgcaacgagcgcaacccttgtccttatttgctaacaggtcatgctgaggactataaggagactgccggtgataaatcggaggaaggagaggatgacgtcaggtcctcatggcccttatgggctgggctacacacgtgctacaatggtgacgacaaagggaagcgacggggagaccctgagcgaatcctaaaacgtcatctcagttcggattgttctctgcaactcgagaacatgaagttggaatcgctagtaatcgtggatcagcacgccacggtgaatacgttcacgggccttgtacacaccgcccgtcaagccatgggagttgatcttacctgaaaccagtgagctaaccgcaaggaggcagctgactatggtggggttgatgactggggttaagtcgtaacaaggtagccgtaggggaacctgcggctggatcacctcctttcta

SEQ ID NO: 4286 - DNA, 1493 bp, Holospora undulata
  ref <308>: DATABASE ACCESSION NUMBER: NCBI ACCESSION: NZ_ARPM03000111.1
  ref <309>: DATABASE ENTRY DATE: 2019-04-01
  ref <313>: RELEVANT RESIDUES IN SEQ ID NO: (1)..(1493)
aaacatgagagtttgatcctggctcagaacgaacgctggcggcatgcttaacacatgcaagtcaaacgagaggcagcaatgtctctagtggcaaacgggtgagtaacgcgtgggaatctgccttttggagggggacaaccgagggaaaccttggctaataccgcatatacttagaaataagaaaagatttatcgccaaaagatgagcccgcgtcagattaggtagttggtggggtaaaggcctaccaagcctacgatctgtagctggtctgagaggatgatcagccacactgggattgagatacggcccagactcctacgggaggcagcagtgaggaatattggacaatgggggaaaccctgatccagcaatgccgcgtgaatgaagaaggccttcgggtcgtaaaattcttttactcgtgaagatgatgacggtaacgagagaaaaagccccggctaactctgtgccagcagccgcggtaatacagagggggctagcgttgttcggaataactgggcgtaaagggtgcgtaggtggttttttaagtgagatgttaaatacccgggcttaacctggggggtgcgtttcaaactggaagactagagtgcggtagaggaaagtggaattcctagtgtagaggtgaaattcgtagatattaggaggaacatcagaggcgaaagcgactttctggtccgtaactgacactgaggcacgaaagcgtggggagcaaacaggattagataccctggtagtccacgccctaaacgatgagtgctagacgtcagctttataagttggtgtcgcagctaacgcattaagcactccgcctgaggactacgatcgcaagattaaaacttaaaggaattgacgggggcccgcacaagcggtggagcatgtggtttaattcgtcaacacgcgaagaaccttaccagctcttgacatgggagtcaccgattctagagatagaatcttcggttcggccggactccacacaggtgctgcatggctgtcgtcagctcgtgtcgtgagatattgggttaagtcccgcaacgagcgcaacccttgtccttatttgctaacaggtaatgctgaggactataaggagactgccggtgataaatcggaggaaggagaggatgacgtcaggtcctcatggcccttatgggctgggctacacacgtgctacaatggtggcgacaaagggaagcaacggggagaccctgagcaaatcctaaaacgtcatctcagttcggattgttctctgcaactcgagaacatgaagttggaatcgctagtaatcgtggatcagcacgccacggtgaatacgttcacgggccttgtacacaccgcccgtcaagccatgggagttgattctacctgaaaccagtgagctaaccgaaaggaggcagctgactatggtggggttgatgactggggttaagtcgtaacaaggtagccgtaggggaacctgcggctggatcacctcctttcta

SEQ ID NO: 4287 - DNA, 1129 bp, Hugenholtzia roseola
  ref <308>: DATABASE ACCESSION NUMBER: NCBI ACCESSION: NZ_AUGI01000087.1
  ref <309>: DATABASE ENTRY DATE: 2019-04-01
  ref <313>: RELEVANT RESIDUES IN SEQ ID NO: (1)..(1129)
ccagccatgccgcgtgtcagatgaaggtcctctggattgtaaatgacttttctacgggaagaatgagccgtctgcggacggaagttgacggtaccgtaggaataagcaccggctaactacgtgccagcagccgcggtaatacgtagggtgcaagcgttgtccggatttactgggtttaaagggtacgtaggcggttgtgccaagtctggggtgaaagtttgcagctcaactgtaaaattgccttggatactggtcggctagagtagtggagcggtggctggaatttatagtgtagcggtgaaatgcttagatactatgaggaacaccaattgcgaaggcaggtcactggtcactaactgacgctgaggtacgaaagtgtggggatcaaacaggattagataccctggtagtccacactgtaaacgatggttactcggtgcgtgccgcttcggtggtgcgtgcctgagcgaaagcgttaagtaacccacctggggagtacgcccgcaagggtgaaactcaaaggaattgacgggggtccgcacaagcggtggagcatgtggtttaattcgatgatacgcgaggaaccttacctgggatagaatgtgagagaccgctgccgaaaggtggcttcccgcaagggctcaaaacaaggtgctgcatggctgtcgtcagttcgtgccgtgaggtgttgggttaagtcccgcaacgaacgcaacccctattgttagttgccagcgagtaatgtcggggactctaacaagactgcctacgcaagtagtgaggaaggaggggacgacgtcaagtcatcatggcccttacacccagggctacacacgtgctacaatggatgatacaaagggttgctagacagcgatgttcggctaatcccaaaaagtcattctcagttcggattgaagtctgcaactcgacttcatgaagttggaatcgctagtaatcgcgcatcagcaacggcgcggtgaatacgttcccggaccttgtacacaccgcccgtcaagccatggaagttgggtgcgcctgaagacagtggccgtcataggagctgtttagggcgaaaccagtaactggggctaagtcgtaacaaggtagccgtaccggaaggtgtggctgg

SEQ ID NO: 4288 - DNA, 1528 bp, Humibacter sp. BT305
  ref <308>: DATABASE ACCESSION NUMBER: NCBI ACCESSION: NZ_CP031192.1
  ref <309>: DATABASE ENTRY DATE: 2019-04-01
  ref <313>: RELEVANT RESIDUES IN SEQ ID NO: (1)..(1528)
tttatggagagtttgatcctggctcaggacgaacgctggcggcgtgcttaacacatgcaagtcgaacggtgaaggtggagcttgctctgctggatcagtggcgaacgggtgagtaacacgtgagcaatctgccccgaactctgggataaccacgggaaaccgtggctaatactggatatgtcgagtgaccgcatggtctgctcgtggaaagatttttcggttcgggatgagctcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtctgtcgcgtctgctgtgaaatcccgaggctcaacctcgggcctgcagtgggtacgggcagactagagtgcggtaggggagaatggaactcctggtgtagcggtggaatgcgcagatatcaggaagaacaccgatggcgaaggcagttctctgggccgtaactgacgctgaggagcgaaagcgtggggagcgaacaggattagataccctggtagtccacgccgtaaacgttgggcgctagatgtggggaccattccacggtttccgtgtcgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacacgagaacgggccagaaatggtcaactctttggacactcgtgaacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggatcggtgattaggactaagtcgtaacaaggtagccgtaccggaaggtgcggctggatcacctcctttcta

SEQ ID NO: 4289 - DNA, 1492 bp, Humitalea rosea
  ref <308>: DATABASE ACCESSION NUMBER: NCBI ACCESSION: NZ_QKYU01000056.1
  ref <309>: DATABASE ENTRY DATE: 2019-04-01
  ref <313>: RELEVANT RESIDUES IN SEQ ID NO: (1)..(1492)
tgaacctgagagtttgatcctggctcagagcgaacgctggcggcatgcttaacacatgcaagtcgcacgggcagcaatgtcagtggcggacgggtgagtaacgcgtaggaacatgtccaggggtgggggataacgtcgggaaactgacgctaataccgcatgtgagctgaggctcaaagcagcgatgcgcctttggagtggcctgcgtccgattaggtagttggtggggtaaaggcctaccaagcctatgatcggtagctggtctgagaggacgatcagccacactgggactgagacacggcccagactcctacgggaggcagcagtggggaatattggacaatgggcgcaagcctgatccagcaatgccgcgtgtgtgaagaaggtcttcggattgtaaagcactttcgacagggacgatgatgacggtacctgtagaagaagccccggctaacttcgtgccagcagccgcggtaatacgaagggggctagcgttgctcggaattactgggcgtaaagggcgcgtaggcggcggagtcagtcaggcgtgaaattcccgggcttaacctggggactgcgcttgatacggctatgctagaggatggaagaggctcgtggaattcccagtgtagaggtgaaattcgtagatattgggaagaacaccggtggcgaaggcggcgagctggtccattactgacgctgaggcgcgaaagcgtggggagcaaacaggattagataccctggtagtccacgctgtaaacgatgtgtgctggatgttgggtgacctagtcactcagtgtcgtagctaacgcggtaagcacaccgcctggggagtacggccgcaaggttgaaactcaaaggaattgacgggggcccgcacaagcggtggagcatgtggtttaattcgaagcaacgcgcagaaccttaccagcccttgacatggacggaagctccgagagattggagtgtgctcgcaagagagccgtcgcacaggtgctgcatggctgtcgtcagctcgtgtcgtgagatgttgggttaagtcccgcaacgagcgcaaccctcgcctttagttgccatcgggttatgccgggcactctagaggaactgccggtgacaagccggaggaaggtggggatgacgtcaagtcctcatggcccttatgggctgggctacacacgtgctacaatggcggtgacaatgggaagccaggtcgcgagatcgagccgatcccaaaaagccgtctcagttcagatcgcactctgcaactcgagtgcgtgaaggtggaatcgctagtaatcgcggatcagcatgccgcggtgaatacgttcccgggccttgtacacaccgcccgtcacaccatgggagttggttttaccttaagtgggtgcgctaaccgcaagggggcagctcaccacggtagggtcagcgactggggtgaagtcgtaacaaggtagccgtaggggaacctgcggctggatcacctcctttcaag

SEQ ID NO: 4290 - DNA, 1518 bp, Hungateiclostridium cellulolyticum
  ref <308>: DATABASE ACCESSION NUMBER: NCBI ACCESSION: NZ_JH556655.1
  ref <309>: DATABASE ENTRY DATE: 2019-04-01
  ref <313>: RELEVANT RESIDUES IN SEQ ID NO: (1)..(1518)
tttttagagagtttgatcctggctcaggacgaacgctggcggcgtgcttaacacatgcaagtcgagcggagaatatagcaatatattcttagcggcggacgggtgagtaacgcgtgggcaatctgcctcatacagggggataacactgggaaactagtgctaataccgcataaaatagtgaagtggcatcactttactatcaaaggagcaatccggtgtgagatgagcccgcgtccgattagctagttggtggggtaacggcccaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggatgaaggttttcggattgtaaacttctttgattggggacgataatgacggtacccaaaaaacaagccacggctaactacgtgccagcagccgcggtaatacgtaggtggcaagcgttgtccggatttactgggtgtaaagggcgtgtaggcggggatgcaagtcagatgtgaaattccggggctcaaccccggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcgaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacataccattgacgtatctagagataggtatttccttcgggacaatggatacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctattacagagggaagcgaagccgtgaggtggagcaaatctccaaaaatagtcccagttcagattgtaggctgaaactcgcctacatgaagtcggaattgctagtaatggcaggtcagcatactgccgtgaatacgttcccgggccttgtacacaccgcccgtcacaccatgagagtctgcaacacccgaagtcagtagtctaactgtaaagaggacgctgccgaaggtggggccgatgattggggtgaagtcgtaacaaggtagccgtatcggaaggtgcggctggatcacctcctttctaagga

SEQ ID NO: 4291 - DNA, 1694 bp, Hungateiclostridium clariflavum
  ref <308>: DATABASE ACCESSION NUMBER: NCBI ACCESSION: NZ_KI913112.1
  ref <309>: DATABASE ENTRY DATE: 2019-04-01
  ref <313>: RELEVANT RESIDUES IN SEQ ID NO: (1)..(1694)
tttttagagagtttgatcctggctcaggacgaacgctggcggcgtgcctaacacatgcaagtcgagcggttctgcattcaacattgagtattcagctgacgttggagattgagccggcgtcaagcagaaacaaacataatatacatgatgatgttttaaagtttctgcttcacgcctgaataaagtgccaaccacaaaaaggagctgagtattgaatgttgaatgcaggatagcggcggacgggtgagtaagcgcgtgggtaaatctgcctcacacagggggataacacatgggaacacgagtcctgtgctaataccgcataacataacgaggtggcatcactttgttatcaaaggagcgaatccggtgtgagatgagcccgcgtccgattagctagttggtgaggtaacggctcaccaaggcgacgatcggtagccgaactgagaggttgatcggcccattgggactgagacacggcccagactcctacgggagggagcagcagtggggaatattgcgcaatgggggaaaccctgacacgcaagcaacgccgcgtgaagggaaaaaggtcttcggattgtaaacttctttgggttggggacgactcatggtaggccacgatacccaaggaacaaagccacggctaactacgtgccagcagccgcggggtaatacgtaggtggcgagcgttgtccggaattactgggtggtaaaggggcgcgtaggcggggatgcaagtcagatgtgaaattccggggctcaaccccggcgctgcatctgaaactgtatttcttgagtgctgggagaggaaagcggaattcctagtgtagcggtgaaatgcgtagagattaggaggaacaccagtggcgaaggcggctttctggacagtaactgacgctgaggcgcgaaagcgtggggagcaaacaggattagataccctggtagtccacgccgtaaacgatggatactaggtgtaggaggtttcgaccccttctgtgccggagttaacacaataagtatcccacctggggagtacgggcgccaaggttgaaactcaaaggaattgacgggggcccgcacaagcagtggagtatgtggtttaattcgaagcaacgcgaagaaccttaccagggcttgacatccctctgacagctctagagatagggcttctcttcggagcagaggagacagggtggtgcatggttgtcgtcagctcgtgtcgtgagatgttgggttaagtcccgcaacgagcgcaacccttgttgttagttggccatcattaagttgggcactctaacgagactgccggtgataaatcggaggaaggtggggacgacgtcaaatcatcatgccccttatgtcctgggctacacaccgtactacaatggctgctacaaagggaagcgagaccgcgaggtggagcaaatccccaaaagcagtcccagttcagattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgagagggaggggcgctgccgaaggtggggcagatgattggggtgaagtcgtaacaaggtagccgtatcggaaggtgtgcggctggatcacctccctttct

SEQ ID NO: 4292 - DNA, 1532 bp, Hungateiclostridium saccincola
  ref <308>: DATABASE ACCESSION NUMBER: NCBI ACCESSION: NZ_NEMB01000003.1
  ref <309>: DATABASE ENTRY DATE: 2019-04-01
  ref <313>: RELEVANT RESIDUES IN SEQ ID NO: (1)..(1532)
tttattagagggtttgatcctggctcaggatgaacgctggcggcgtgcctaacacatgcaagtcgagcggggtatacggagcagcttgctgcactgtagacctagcggcggacgggtgagtaacgcgtgggtaacctgccttacacagggggataacactgggaaaccagtgctaataccgcataacatcattttatggcatcatgaaatgatcaaaggagaaatccggtgtaagatgggcccgcgtccgattagctagttggtgaggtaatggctcaccaaggcagcgatcggtagccggactgagaggttggccggccacattgggactgagacacggcccagactcctacgggaggcagcagtggggaatattgcgcaatggggggaaccctgacgcagcgacgccgcgtgaaggaagaaggccttcgggttgtaaacttctttgattggggaagaaaaatgacggtacccaaagaacaagccacggctaactacgtgccagcagccgcggtaatacgtaggtggcgagcgttatccggaattactgggtgtaaagggcgtgtaggcggggatgcaagtcagatgtgaaattccggggctcaacctcggcactgcatctgaaactgtgtctcttgagtgctggagaggaaagtggaattcctagtgtagcggtgaaatgcgtagagattaggaggaacaccagtggcgaaggcgactttctggacagcaactgacgctgaggcgcgagagcgtggggagcaaacaggattagataccctggtagtccacgccgtaaacgatggatactaggtgtaggaggtatcgaccccttctgtgccgtagttaacacaataagtatcccacctggggagtacggccgcaaggctgaaactcaaaggaattgacgggggcccgcacaagcagtggagtatgtggtttaattcgaagcaacgcgaagaaccttaccagggcttgacatcccttgaccgctgtagaaatacagtttcccttcggggcaaggagacaggtggtgcatggttgtcgtcagctcgtgtcgtgagatgttgggttaagtcccgcaacgagcgcaacccctgtcgttagttgccagcacgtagaggtgggcactctagcgagactgccggtgacaaatcggaggaaggtggggacgacgtcaaatcatcatgccccttatgtcctgggctacacacgtactacaatggttgctacagagggcagcgaagccgcgaggtggagcaaatccctaaaagcagccccagttcggattgcaggctgaaactcgcctgcatgaagtcggaattgctagtaatggcaggtcagcatactgccgtgaatacgttcccgggccttgtacacaccgcccgtcacaccatgagagtcggcaacacccgaagtcagtagtctaaccgcaagggggacgctgccgaaggtggggctgatgattggggtgaagtcgtaacaaggtagccgtatcggaaggtgcggctggatcacctcctttctaagga

SEQ ID NO: 4293 - DNA, 1169 bp, Hungateiclostridium sp. N2K1
  ref <308>: DATABASE ACCESSION NUMBER: NCBI ACCESSION: NZ_RLII01000089.1
  ref <309>: DATABASE ENTRY DATE: 2019-04-01
  ref <313>: RELEVANT RESIDUES IN SEQ ID NO: (1)..(1169)
ggctcaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggaagaaggccttcgggttgtaaacttctttgattggggacgaagaaagtgactgtacccaaaaaacaagccacggctaactacgtgccagcagccgcggtaatacgtaggtggcaagcgttgtccggaattactgggtgtaaagggcgtgtaggcgggtgaccaagtcagatgtgaaattccggggcttaactccggcgctgcatctgaaactggacatcttgagtgctggagaggaaagcggaattcctagtgtagcggtgaaatgcgtagatattaggaggaacaccagtggcgaaggcggctttctggacagtaactgacgctgaggcgcgaaagcgtggggagcaaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatcccttgacgatcctagagataggatttctcttcggagcaaggagacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctgttacagagggaagctaagccgcgaggtggagcaaacccccaaaggcagccccagttcagattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgcaaggagg

SEQ ID NO: 4294 - DNA, 1526 bp, Hungateiclostridium straminisolvens
  ref <308>: DATABASE ACCESSION NUMBER: NCBI ACCESSION: NZ_BAVR01000144.1
  ref <309>: DATABASE ENTRY DATE: 2019-04-01
  ref <313>: RELEVANT RESIDUES IN SEQ ID NO: (1)..(1526)
tttttagagagtttgatcctggctcaggacgaacgctggcggcgtgcctaacacatgcaagtcgagcggagatatattgaagatttatcggatatatatcttagcggcggacgggtgagtaacgcgtgggtaacctgcctcatacagggggataacacagggaaacttgtgctaataccgcataacataacgaggcggcatcgctttgttatcaaaggagcaatccggtatgagatgggcccgcgtccgattagctagttggtgaggtaacggctcaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggaagaaggccttcgggttgtaaacttctttgattggggacgaagaaagtgactgtacccaaaaaacaagccacggctaactacgtgccagcagccgcggtaatacgtaggtggcaagcgttgtccggaattactgggtgtaaagggcgtgtaggcggggatgcaagtcagatgtgaaattccggggcttaaccccggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcaaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatcccttgaaagtcctagagataggatttctcttcggagcaaggagacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctgttacaaagggaagctaagccgcgaggtggagcaaatccccaaaggcagccccagttcagattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgcaaggaggacgctgccgaaggtggggccgatgattggggtgaagtcgtaacaaggtagccgtatcggaaggtgcggctggatcacctcctttct

SEQ ID NO: 4295 - DNA, 1535 bp, Hungateiclostridium thermocellum
  ref <308>: DATABASE ACCESSION NUMBER: NCBI ACCESSION: NZ_OCMV01000002.1
  ref <309>: DATABASE ENTRY DATE: 2019-04-01
  ref <313>: RELEVANT RESIDUES IN SEQ ID NO: (1)..(1535)
tttttagagagtttgatcctggctcaggacgaacgctggcggcgtgcctaacacatgcaagtcgagcggggatatacggaaggtttaccggaagtatatcctagcggcggacgggtgagtaacgcgtgggtaacctacctcatacagggggataacacagggaaacctgtgctaataccgcataatataacggggcggcatcgtcctgttatcaaaggagaaatccggtatgagatgggcccgcgtccgattagctagttggtgaggtaacggctcaccaaggcgacgatcggtagccgaactgagaggttggtcggccacattgggactgagacacggcccagactcctacgggaggcagcagtggggaatattgcgcaatgggggaaaccctgacgcagcaacgccgcgtgaaggaagaaggccttcgggttgtaaacttctttgattggggacgaaggaagtgacggtacccaaagaacaagccacggctaactacgtgccagcagccgcggtaatacgtaggtggcgagcgttgtccggaattactgggtgtaaagggcgcgtaggcggggatgcaagtcagatgtgaaattccggggcttaaccccggcgctgcatctgaaactgtatctcttgagtgctggagaggaaagcggaattcctagtgtagcggtgaaatgcgtagatattaggaggaacaccagtggcgaaggcggctttctggacagtaactgacgctgaggcgcgaaagcgtggggagcaaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatccctctgacagctctagagatagggcttcccttcggggcagaggagacaggtggtgcatggttgtcgtcagctcgtgtcgtgagatgttgggttaagtcccgcaacgagcgcaacccttgtcgttagttgccagcacgttaaggtgggcactctagcgagactgccggcgacaagtcggaggaaggtggggacgacgtcaaatcatcatgccccttatgtcctgggctacacacgtactacaatggctgctacaaagggaagcgataccgcgaggtggagcaaatccccaaaagcagtcccagttcggattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgcaaggagggcgctgccgaaggtggggcagatgattggggtgaagtcgtaacaaggtagccgtatcggaaggtgcggctggatcacctcctttctaagga

SEQ ID NO: 4296 - DNA, 1540 bp, Hungatella effluvii
  ref <308>: DATABASE ACCESSION NUMBER: NCBI ACCESSION: NZ_QJKD01000041.1
  ref <309>: DATABASE ENTRY DATE: 2019-04-01
  ref <313>: RELEVANT RESIDUES IN SEQ ID NO: (1)..(1540)
taacatgagagttcgatcctggctcaggatgaacgctggcggcgtgcttaacacatgcaagtcgagcgaagcgattaagaggaagttttcggatggaatcttgattgacttagcggcggacgggtgagtaacgcgtgggtaacctgccttacactgggggataacagttagaaatgactgctaataccgcataagcgcacagggccgcatggtctggtgtgaaaaactccggtggtgtaagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggcgaaagcctgatccagcgacgccgcgtgagtgaagaagtgtttcggcatgtaaagctctatcagcagggaagaaaatgacggtacctgactaagaagccccggctaactacgtgccagcagccgcggtaatacgtagggggcaagcgttatccggatttactgggtgtaaagggagcgtagacggttaagcaagtctgaagtgaaagcccggggctcaaccccggtactgctttggaaactgtttgacttgagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcgggggacaaagtccttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgaaaatcatttaaccgtgatccctcttcggagcaatggagacaggtggtgcatggttgtcgtcagctcgtgtcgtgagatgttgggttaagtcccgcaacgagcgcaacccttatccttagtagccagcacataatggtgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgcaggctgcaactcgcctgcatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctcctttctaaggaa

SEQ ID NO: 4297 - DNA, 1542 bp, Hungatella hathewayi
  ref <308>: DATABASE ACCESSION NUMBER: NCBI ACCESSION: NZ_QRQF01000035.1
  ref <309>: DATABASE ENTRY DATE: 2019-04-01
  ref <313>: RELEVANT RESIDUES IN SEQ ID NO: (1)..(1542)
tttaacatgagagttcgatcctggctcaggatgaacgctggcggcgtgcttaacacatgcaagtcgagcgaagcggttttaatgaagttttcggatggaattgaaattgacttagcggcggacgggtgagtaacgcgtgggtaacctgccttacactgggggataacagttagaaatgactgctaataccgcataagcgcacagggccgcatggtctggtgtgaaaaactccggtggtgtaagatggacccgcgtctgattaggtagttggtggggtaacggcccaccaagccgacgatcagtagccgacctgagagggtgaccggccacattgggactgagacacggcccaaactcctacgggaggcagcagtggggaatattggacaatgggcgaaagcctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggttaagcaagtctgaagtgaaagcccggggctcaaccccggtactgctttggaaactgtttgacttgagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcgggggacaaagtccttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgaaaacactttaaccggtgaccctcttcggagcaatggagacaggtggtgcatggttgtcgtcagctcgtgtcgtgagatgttgggttaagtcccgcaacgagcgcaacccttatccttagtagccagcaagtaatgttgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgcaggctgcaactcgcctgcatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacctcctttctaaggaa

SEQ ID NO: 4298 - DNA, 1307 bp, Hwanghaeicola aestuarii
  ref <308>: DATABASE ACCESSION NUMBER: NCBI ACCESSION: NZ_QKZL01000063.1
  ref <309>: DATABASE ENTRY DATE: 2019-04-01
  ref <313>: RELEVANT RESIDUES IN SEQ ID NO: (1)..(1307)
ccccttcggggggaaagattcatcggagaaggatcggcccgcgtctgattagatagttggtggggtaacggcctaccaagtcgacgatcagtagctggtttgagaggatgatcagcaacactgggactgagacacggcccagactcctacgggaggcagcagtggggaatcttagacaatgggcgcaagcctgatctagccatgccgcgtgagtgacgaaggccctagggtcgtaaagctctttcgctggggaagataatgactgtacccagtaaagaagtcccggctaactccgtgccagcagccgcggtaatacggaggggactagcgttgttcggaattactgggcgtaaagcgcgcgtaggcggacatttaagtcaggggtgaaatcccggggctcaaccccggaactgcccttgatactgggtgtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgtggatcgtactttcgggagaccgattggtcagttcggctggatccagcacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggcagtgacaatgggttaatccccaaaaactgtctcagttcggattgtcgtctgcaactcgacggcatgaagtcggaatcgctagtaatcgtggaacagcatgccacggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttcta

SEQ ID NO: 4299 - DNA, 519 bp, Hydrococcus rivularis
  ref <308>: DATABASE ACCESSION NUMBER: NCBI ACCESSION: NZ_MRCB01000064.1
  ref <309>: DATABASE ENTRY DATE: 2019-04-01
  ref <313>: RELEVANT RESIDUES IN SEQ ID NO: (1)..(519)
gccggaacacaggtgctgcatggctgtcgtcagctcgtgtcgtgagatgttgggttaagtcccgcaacgagcgcaaccctcgttcttagttgccagcaggtaaagctgggcactctaggaagactgccgatgacaaatcggaggaaggtggggatgacgtcaagtcagcatggcccttacgtcctgggcgacacacgtactacaatggtggggacaaagggcagcgaccccgcgagggcgagcgaatctcagcaaaccctacctcagttcagattgcaggctgcaactcgcctgcatgaaggaggaatcgctagtaatcgccggtcagcatacggcggtgaatccgttcccgggccttgtacacaccgcccgtcacaccatgggagctggccacgcccgaagtcgttactccaaccgatgaggaggaggatgccgaaggcagggctagtgactggggtgaagtcgtaacaaggtagccgtaccggaaggtgtggctggatcacctcctttttagggaga

SEQ ID NO: 4300 - DNA, 1531 bp, Hydrogenibacillus schlegelii
  ref <308>: DATABASE ACCESSION NUMBER: NCBI ACCESSION: NZ_JXBB01000051.1
  ref <309>: DATABASE ENTRY DATE: 2019-04-01
  ref <313>: RELEVANT RESIDUES IN SEQ ID NO: (1)..(1531)
tacggagagtttgatcctggctcaggacgaacgctggcggcgcgcctaatacatgcaagtcgagcggggaggcgggcggaagccttcgggcggaagcccgtctcttagcggcggacgggtgaggaacacgtaggcaacctgtcctaaagaccgggataacaccgggaaaccggtgctaataccggatagattgtcctggcgcatgctggggcaaggaaaggggcgacccgctttaggaggggcctgcggcgcattagctggttggtggggtaacggcctaccaaggcgatgatgcgtagccggcctgagagggtgaccggccacactgggactgagacacggcccagactcctacgggaggcagcagtagggaatcttccgcaatgggcggaagcctgacggagcgacgccgcgtgggggaggaaggccttcgggttgtaaacccctgttgtcggggaagaagggccgcggaggcggcattgacggtacccgacgaggaagccccggctaactacgtgccagcagccgcggtaatacgtagggggcgagcgttgtccggaatgactgggcgtaaagggcgcgtaggcggcctgttaagtctgctgtgaaaggccacggctcaaccgtgggggtgcagcggaaactggcgggcttgagtgcaggagaggtgcgcggaattcccggtgtagcggtgaaatgcgtagagatcgggaggaacaccgatggcgaaggcagcgcactggcctgtaactgacgctgaggcgcgaaagcgtggggagcgaacaggattagataccctggtagtccacgctgtaaacgatgggtgctaggtgtgggtggggcgacccatccgtgccggagttcacacattaagcaccccgcctggggagtacggccgcaaggctgaaactcaaaggaattgacgggggcccgcacaagcggtggagcatgtggtttaattcgaagcaacgcgaagaaccttaccagggcttgacatcccgctgccgggtccagagatgggcctttcccgcgagggacggcggagacaggtggtgcatggttgtcgtcagctcgtgtcgtgagatgttgggttaagtcccgcaacgagcgcaacccctgcccttagttgccagcgggtgaggccgggcactctaaggggactgccgccgacgaggcggaggaaggtggggatgacgtcaaatcatcatgccccttatgccctgggctacacacgtgctacaatggccggtacagcgggaagcgaagccgcgaggcggagcggatccctgaaagccggtctcagttcggattgcaggctgcaactcgcctgcatgaaggcggaatcgctagtaatcgcggatcagcatgccgcggtgaatgcgttcccgggccttgtacacaccgcccgtcacaccatgggagtcgggggcgcccgaaggcgcgggcagcgctgaaggcgaacctggcgactggggtgaagtcgtaacaaggtatccgtaccggaaggtgcggatggatcacctcctttcta

SEQ ID NO: 4301 - DNA, 1571 bp, Hydrogenivirga caldilitoris
  ref <308>: DATABASE ACCESSION NUMBER: NCBI ACCESSION: NZ_RCCJ01000001.1
  ref <309>: DATABASE ENTRY DATE: 2019-04-01
  ref <313>: RELEVANT RESIDUES IN SEQ ID NO: (1)..(1571)
ttccatgaagagtttgatcctggctcagcgcgaacgctggcggcacgcctaacacatgcaagtcgtggggcatcagaccctccttcgggagggtgctggcgaccggcaaacgggtgagtaacacgtgggtaacctaccctcaggagggggataaccccgggaaaccggggctaataccccataatgccaggcgccactgaggtgtcctggttaaagggggcctctgcttgcaagctcccgcctgaggatgggcccgcggcctatcaggtagttggtggggtaatggcctaccaagcctatgacgggtagccggcctgagagggtagccggccacagcgggactgagacacggcccgcacccctacggggggcagcagtggggaatcgtgggcaatgggcgaaagcctgaccccgcgatgccgcgtgcgggaagaagcccttcggggtgtaaaccgctgtcaggagggacgaagggactgtgggctaatacctcacagtcttgacggtacctccagaggaagggacggctaactacgtgccagcagccgcggtaatacgtaggtcccgagcgttgcgcggagtcactgggcgtaaagcgtccgcagctggtcgggtaagcgggatgtcaaagcccgccgcttaacggcggaacggcatcctgaactgcctgacttgaggcacgcccgggcaggcggaattcccggggtagcggtgaaatgcgtagatctcgggaggaacaccgaaggggaagccagcctgctggggctgtcctgacggtcagggacgaaagccaggggagcgaaccggattagatacccgggtagtcctggccgtaaaccatgggcgctagggctcgtccttctgggcgggctcgcagctaacgcgttaagcgccccgcctggggagtacgggcgcaagcctgaaactcaaaggaattggcgggggcccgcacaaccggtggagcgtctggttcaattcgatgctaaccgaagaaccttacccgggcttgacatgccagggtcacctctgcgaaagcggagggttttcgttcctctggagcgaaccctggcacaggtggtgcatggccgtcgtcagctcgtgtcgtgagatgttgggttaagtcccgcaacgagcgcaacccctgcctccagttgctaccccttttggggagcactctggagggactgccggcgataagccggaggaaggtggggacgacgtcaggtcagtatgccctttatgcccggggccacacaggcgctacagtggccgggacaatgggatgcgacccagcaatggggagccaatccttaaacccggtcatggtgcggattgtgggctgaaactcgcccacatgaagccggaatcggtagtaacggggtatcagcgatgtccccgtgaatacgttctcgggccttgcacacaccgcccgtcacgccacggaagtcggtcctgtcggaagtccccgagctaacccgcaagggaggcaggggccgatgatagggctggcaactggggcgaagtcgtaacaaggtagccgtaggggaacctgcggctggatcacctccttt

SEQ ID NO: 4302 - DNA, 1580 bp, Hydrogenivirga sp. 128-5-R1-1
  ref <308>: DATABASE ACCESSION NUMBER: NCBI ACCESSION: NZ_ABHJ01000001.1
  ref <309>: DATABASE ENTRY DATE: 2019-04-01
  ref <313>: RELEVANT RESIDUES IN SEQ ID NO: (1)..(1580)
tttccatgaagagtttgatcctggctcagcgcgaacgctggcggcacgcctaacacatgcaagtcgcggggcagcagaccctccttcgggagggtgctggcgaccggcaaacgggtgagtaacacgtgggtaacctacccccaggagggggataaccccgggaaaccggggctaataccccataaagctaggaaccacaaaggcttcctagttaaagggggcctctgcttgcaagctcccgcctggggatgggcccgcggcctatcaggtagttggtagggtaacggcctaccaagcctatgacgggtagccggcctgagagggtagccggccacagcgggactgagacacggcccgcacccctacggggggcagcagtggggaatcgtgggcaatgggcgaaagcctgaccccgcgatgccgcgtgcgggaagaagcccttcggggtgtaaaccgctgtcaggagggacgaagggaccgtgggctaatacctcacggtcttgacggtacctccagaggaagggacggctaactacgtgccagcagccgcggtaatacgtaggtcccgagcgttgcgcggagtcactgggcgtaaagcgtccgcagccggctccgtaagcgggatgtcaaagcccgccgcttaacggcggaacggcatcctgaactgcggagcttgaggcacgcccgggcaggcggaattcccggggtagcggtgaaatgcgtagatctcgggaggaacaccgaaggggaagccagcctgctggggctgtcctgacggtcagggacgaaagccaggggagcgaaccggattagatacccgggtagtcctggccgtaaaccatgggcgctagggcttgtccctctggggcaggctcgcagctaacgcgttaagcgccccgcctggggagtacgggcgcaagcctgaaactcaaaggaattggcgggggcccgcacaaccggtggagcgtctggttcaattcgatgctaaccgaagaaccttacccgggcttgacatgccagggtcacctctgcgaaagcggagggttttcgttcctctggagcgaaccctggcacaggtggtgcatggccgtcgtcagctcgtgtcgtgagatgttgggttaagtcccgcaacgagcgcaacccctgcctccagttgctacccgcgagggagcactctggagggactgccggcgataagccggaggaaggtggggatgacgtcaggtcagtatgccctttatgcccggggccacacaggcgctacagtggccgggtcaatgggatgcgacccagcaatggggagctaatcctcaaacccggtcatggtgcggattgtgggctgaaactcgcccacatgaagccggaatcggtagtaacggggtatcagcgatgtccccgtgaatacgttctcgggccttgcacacaccgcccgtcacgccacggaagtcggtcctgtcggaagtccccgagctaaccggccttcgggccggaggcaggggccgatgacagggctggcaactggggcgaagtcgtaacaaggtagccgtaggggaacctgcggctggatcacctcctttata

SEQ ID NO: 4303 - DNA, 1555 bp, Hydrogenobacter hydrogenophilus
  ref <308>: DATABASE ACCESSION NUMBER: NCBI ACCESSION: NZ_OBEN01000010.1
  ref <309>: DATABASE ENTRY DATE: 2019-04-01
  ref <313>: RELEVANT RESIDUES IN SEQ ID NO: (1)..(1555)
ttccttgaagagtttgatcctggctcagcgcgaacgctggcggcgtgcctaacacatgcaagtcgtgcggggtggctctgccacccagcggcaaacgggtgagtaacacgtgagtaacctgccctcaggaaggggataaccctccgaaaggggggctaataccctataatgtccgggaccactaaggtttccggaccaaaggtggcctctgctctgcaagctaccgcctgaggaggggctcgcggcccatcaggtagttggtggggtaatggcctaccaagcctatgacgggtagccggcttgagagggtggccggccacagtgggactgagacacggcccacacccctacggggggcagcagtggggaatcgtgggcaatgggcgaaagcctgaccccgcgacgccgcgtggaggaagaagcccttcggggtgtaaactcctgtcaggggggaagatgctcacaggggtgaataatctctgtgggtgactgtacccccagaggaagggacggctaactacgtgccagcagccgcggtaatacgtaggtcccgagcgttgcgcgaattcactgggcgtaaagcgtccgcagccggatgggtaagcggtttgtcaaagcccaccgctcaacggtggaaaggcataccgaactgcccatcttgaggcacgctcaggtaggcggaattcccggtgtagcggtgaaatgcgtagatatcgggaggaacaccggtggcgaaggcggcctactggggctgtcctgacggtcagggacgaaagctgggggagcaaaccggattagatacccgggtagtcccagccgtaaaccatgggcgctaggcgttgtccgcaagggcagtgcctcagctaacgcggtaagcgccccgcctggggagtacgggcgcaagcctgaaactcaaaggaattggcgggggcccgcacaaccggtggagcgtctggttcaattcgatgctaaccgaaaaaccttacccgggcttgacatggtaggaaacccttgcgaaagcgaggggtgccgtcctctggacggaatcctaccacaggtggtgcatggccgtcgtcagctcgtgtcgtgagatgttgggttaagtcccgcaacgagcgcaacccctgcccttagttgccactcttcggagggcactctaaggggactgccggcgataagccggaggaaggtggggatgacgtcaggtcagtatgccctttatgcccggggctacacaggcgctacagtggccgggacaatgggaagcgacccagcaatggggagcaaatcctccaaacccggtcatggtgcagattgagggctgaaactcgccctcatgaagccggaatcggtagtaatggcggatcagctaagccgccgtgaatacgttctcgggccttgcacacaccgcccgtcacgccacggaagtcagtcttcccggaagccctcgagctaacccgcaagggaggcagaggacgatgggaaggctggcaactggggcgaagtcgtaacaaggtagccgtaggggaacctgcggctggatcacctcctttat

SEQ ID NO: 4304 - DNA, 1557 bp, Hydrogenobacter thermophilus
  ref <308>: DATABASE ACCESSION NUMBER: NCBI ACCESSION: NC_017161.1
  ref <309>: DATABASE ENTRY DATE: 2019-04-01
  ref <313>: RELEVANT RESIDUES IN SEQ ID NO: (1)..(1557)
ttttcttgaagagtttgatcctggctcagcgcgaacgctggcggcgtgcctaacacatgcaagtcgtgcggggtggctctgccacccagcggcaaacgggtgagtaacacgtgagtaacctgccctcaggaaggggataaccctccgaaaggggggctaataccctataaagccaggggtcacaaaggctacctggccaaagggggcctctgctctgcatgctcccgcctgaggaggggctcgcggcccatcaggtagttggtggggtaacggcctaccaagcctatgacgggtagccggcctgagagggtggccggccacagtgggactgagacacggcccacacccctacggggggcagcagtggggaatcgtgggcaatgggcgaaagcctgaccccgcgacgccgcgtggaggaagaagcccttcggggtgtaaactcctgtcaggggggaagatgctcacagaggcgaatagtctctgtgggtgactgtacccccagaggaagggacggctaactacgtgccagcagccgcggtaatacgtaggtcccgagcgttgcgcgaatttactgggcgtaaagcgtccgcagccggatgggtaagcggtttgtcaaagcccaccgctcaacggtggaaaggcataccgaactgcccatcttgaggcacgctcaggtaggcggaattcccggtgtagcggtgaaatgcgtagatatcgggaggaacaccggtggcgaaggcggcctactggggctgtcctgacggtcagggacgaaagctgggggagcaaaccggattagatacccgggtagtcccagccgtaaaccatgggcgctaggcgttgtccgcaagggcagtgcctcagctaacgcggtaagcgccccgcctggggagtacgggcgcaagcctgaaactcaaaggaattggcgggggcccgcacaaccggtggagcgtctggttcaattcgatgctaaccgaaaaaccttacccgggtttgacatggtgggaaacccttgcgaaagcgaggggtgccgtcttctggacggaatcccaccacaggtggtgcatggccgtcgtcagctcgtgtcgtgagatgttgggttaagtcccgcaacgagcgcaacccctgcccttagttgctactcttcggagggcactctaaggggactgccggcgataagccggaggaaggtggggatgacgtcaggtcagtatgccctttatgcccggggctacacaggcgctacagtggccgggacaatgggaagcgactcagtaatgaggagcaaatcctataaacccggtcatggtgcggattgagggctgaaactcgccctcatgaagccggaatcggtagtaatggcggatcagctaagccgccgtgaatacgttctcgggccttgcacacaccgcccgtcacgccacggaagtcagtcttcccggaagccctcgggctaacccgtaagggaggtagaggacgatgggaaggctggcaactggggcgaagtcgtaacaaggtagccgtaggggaacctgcggctggatcacctcctttata

SEQ ID NO: 4305 - DNA, 1555 bp, Hydrogenobaculum sp. 3684
  ref <308>: DATABASE ACCESSION NUMBER: NCBI ACCESSION: NC_015557.1
  ref <309>: DATABASE ENTRY DATE: 2019-04-01
  ref <313>: RELEVANT RESIDUES IN SEQ ID NO: (1)..(1555)
ttgaagagtttgatcctggctcagcgcgaacgctggcggcatgcctaacacatgcaagtcgtacggagagtggggcaactcactctcagtggcaaacgggtgagtaacgcgtgaataacctgcctttgagaaggggataactgtccgaaaggatagctaataccctatattgccttttgtcactaaggcaaaaggtgaaagcgaggctgtcaaaggcttcggctcaaagaggggttcgcgtcctatcaggtagttggtggggtaatggcctaccaagccaatgacgggtagctggtcttagaggatgatcagccacagtgggactgagacacggcccgcacccctacggggggcagcagtggggaatcgtgggcaatgggcgcaagcctgaccccgcaatgccgcgtgagggaagaagcccttcggggtgtaaacctctgtcagatgggaagatgggactaggggctaatacctcctggtcttgacggtaccatcagaggaagggacggctaactacgtgccagcagccgcggtaatacgtaggtcccgagcgttgcgcgatgttactgggcgtaaagcgtccgtagctggtttcgtaagcggattgtcaaagcccgaagctcaacttcggcaaggcattccgaactgcgttacttgagtcctgttcaggtaggcggaattcccggtgtagcggtgaaatgcgtagatatcgggaggaacaccagtggcgaaggcggcctactgggacggtactgacggtcatggacgaaagctgggggagcaaaccggattagatacccgggtagtcccagccgtaaacgatggatgttaggtgtagtgataacttcgctgcaccccagctaacgcgttaaacatcccgcctggggagtacgggcgcaagcctgaaactcaaaggaattggcgggggcccgcacaaccggtggagcgtctggtttaattcgatgctaaccgaaaaaccttaccagggtttgaaatggtaggaaaggctgtcgaaagatagccgtgtttcccttttgggagaaatcctaccacaggtggtgcatggccgtcgtcagctcgtgttgtgagatgttgggttaagtcccgcaacgagcgcaacccttgtccttatttgcttcctcgtatgaggtgctctataaggagactgccggcgacaagccggaggaaggaggggacgacgtcaggtcagtatgccctttatgccctgggctacacaggcgctacagtggcaaggacaatgagtagcgagagtgcaagctcaagctaatctcacaaaccttgtcgtggtgcgaattgaaggttgaaactcaccttcatgaagccggaatcggtagtaatggcgtatcagctatgtcgccgtgaatacgttcccgggccttgcacacaccgcccgtcacgccacggaagctggtgttttcggaagtcctcaagctaacccgcaagggaggcagaggccgatgaaaacatcggtaactggggcgaagtcgtaacaaggtagccgtaggggaacctgcggctggatcacctccttttt

SEQ ID NO: 4306 - DNA, 1557 bp, Hydrogenobaculum sp. HO
  ref <308>: DATABASE ACCESSION NUMBER: NCBI ACCESSION: NC_020411.1
  ref <309>: DATABASE ENTRY DATE: 2019-04-01
  ref <313>: RELEVANT RESIDUES IN SEQ ID NO: (1)..(1557)
ttgaagagtttgatcctggctcagcgcgaacgctggcggcatgcctaacacatgcaagtcgtacggagagtggggcaactcactctcagtggcaaacgggtgagtaacgcgtgaataacctgcctttgagaaggggataactgtccgaaaggatagctaataccctatattgccttttgtcactaaggcaaaaggtgaaagcgaggctgtcaaaggcttcggctcaaagaggggttcgcgtcctatcaggtagttggtggggtaatggcctaccaagccaatgacgggtagctggtcttagaggatgatcagccacagtaggactgagacacggcccgcacccctacggggggcagcagtggggaatcgtgggcaatgggcgcaagcctgaccccgcaatgccgcgtgagggaagaagcccttcggggtgtaaacctctgtcagatgggaagatgggactaggggctaatacctcctagtcttgacggtaccatcagaggaagggacggctaactacgtgccagcagccgcggtaatacgtaggtcccgagcgttgcgcgatgttactgggcgtaaagcgtccgtagctggtttcgtaagcggattgtcaaagcccgaagctcaacttcggcaaggcattccgaactgcgttacttgagtcctgttcaggtaggcggaattcccggtgtagcggtgaaatgcgtagatatcgggaggaacaccagtggcgaaggcggcctaactgggacggtactgacggtcatggacgaaagctgggggagcaaaccggattagatacccgggtagtcccagccgtaaacgatggatgttaggtgtagtgataacttcgctgcaccccagctaacgcgttaaacatcccgcctggggagtacgggcgcaagcctgaaactcaaaggaattgggcgggggcccgcacaaccggtggagcgtctggtttaattcgatgctaaccgaaaaaccttaccagggtttgaaatggtaggaaaggctgtcgaaagatagccgtgtttcccttttgggagaaatcctaccacaggtggtgcatggccgtcgtcagctcgtgttgtgagatgttgggttaagtcccgcaatgagcgcaacccttgtccttatttgcttcctcgtatgaggtgctctataaggagactgccggcgacaagccggaggaaggaggggacgacgtcaggtcagtatgccctttatgccctgggctacacaggcgctacagtggcaaggacaatgagtagcgagagtgcaagctcaagctaatctcacaaaccttgtcgtggtgcgaattgaaggttgaaactcaccttcatgaagccggaatcggtagtaatggcgtatcagctatgtcgccgtgaatacgttcccgggccttgcacacaccgcccgtcacgccacggaagctggtgttttcggaagtcctcaagctaacccgcaagggaggcagaggccgatgaaaacatcggtaactggggcgaagtcgtaacaaggtagccgtaggggaacctgcggctggatcacctccttttt

SEQ ID NO: 4307 - DNA, 1555 bp, Hydrogenobaculum sp. SHO; identical to SEQ ID NO: 4305
  ref <308>: DATABASE ACCESSION NUMBER: NCBI ACCESSION: NC_015587.1
  ref <309>: DATABASE ENTRY DATE: 2019-04-01
  ref <313>: RELEVANT RESIDUES IN SEQ ID NO: (1)..(1555)

SEQ ID NO: 4308 - DNA, 1555 bp, Hydrogenobaculum sp. SN; identical to SEQ ID NO: 4305
  ref <308>: DATABASE ACCESSION NUMBER: NCBI ACCESSION: NC_020814.1
  ref <309>: DATABASE ENTRY DATE: 2019-04-01
  ref <313>: RELEVANT RESIDUES IN SEQ ID NO: (1)..(1555)

SEQ ID NO: 4309 - DNA, 1555 bp, Hydrogenobaculum sp. Y04AAS1
  ref <308>: DATABASE ACCESSION NUMBER: NCBI ACCESSION: NC_011126.1
  ref <309>: DATABASE ENTRY DATE: 2019-04-01
  ref <313>: RELEVANT RESIDUES IN SEQ ID NO: (1)..(1555)
ttgaagagtttgatcctggctcagcgcgaacgctggcggcatgcctaacacatgcaagtcgtacggagagtggggcaactcactttcagtggcaaacgggtgagtaacgcgtgaataacctgcctttgagaaggggataactgtccgaaaggatagctaataccctatatagccttttgtcactaaggcaaaaggtgaaagcgaggctgtcaaaggcttcggctcaaagaggggttcgcgtcctatcaggtagttggtggggtaatggcctaccaagccaatgacgggtagctggtcttagaggatgatcagccacagtgggactgagacacggcccgcacccctacggggggcagcagtggggaatcgtgggcaatggacgaaagtctgaccccgcaatgccgcgtgagggaagaagcccttcggggtgtaaacctctgtcagatgggaagatgggactaggggctaatacctcctggtcttgacggtaccatcagaggaagggacggctaactacgtgccagcagccgcggtaatacgtaggtcccgagcgttgcgcgatgttactgggcgtaaagcgtccgtagctggtttcgtaagcagattgtcaaaacccgaagctcaacttcggcaaggcattccgaactgcgttacttgagtcctgttcaggtaggcggaattcccggtgtagcggtgaaatgcgtagatatcgggaggaacaccagtggcgaaggcggcctactgggacggtactgacggtcatggacgaaagctgggggagcaaaccggattagatacccgggtagtcccagccgtaaacgatggatgttaggtgtagtgataacttcgctgcaccccagctaacgcgttaaacatcccgcctggggagtacgggcgcaagcctgaaactcaaaggaattggcgggggcccgcacaaccggtggagcgtctggtttaattcgatgctaaccgaaaaaccttaccagggtttgaaatggtaggaaaggctgtcgaaagatagccgtgtttcccttttgggagaaatcctaccacaggtggtgcatggccgtcgtcagctcgtgttgtgagatgttgggttaagtcccgcaacgagcgcaacccttgtccttatttgcttcctcgtatgaggtgctctataaggagactgccggcgacaagccggaggaaggaggggacgacgtcaggtcagtatgccctttatgctctgggctacacaggcgctacagtggcaaggacaatgagtagcaagagtgtaagctcaagctaatctcacaaaccttgtcgtggtgcgaattgaaggttgaaactcaccttcatgaagccggaatcggtagtaatggcgtatcagctatgtcgccgtgaatacgttcccgggccttgcacacaccgcccgtcacgccacggaagctggtgttttcggaagtcctcaagctaacccgcaagggaggcagaggccgatgaaaacatcggtaactggggcgaagtcgtaacaaggtagccgtaggggaacctgcggctggatcacctccttttt

SEQ ID NO: 4310 - DNA, 1537 bp, Hydrogenophaga sp. LA-38
  ref <308>: DATABASE ACCESSION NUMBER: NCBI ACCESSION: NZ_QVLS01000005.1
  ref <309>: DATABASE ENTRY DATE: 2019-04-01
  ref <313>: RELEVANT RESIDUES IN SEQ ID NO: (1)..(1537)
agatcgaactaaagagtttgatcctggctcagattgaacgctggcggcatgctttacacatgcaagtcgaacggtaacaggccgcaaggtgctgacgagtggcgaacgggtgagtaatgcatcggaacgtgcccagtcgtgggggataacgcagcgaaagctgcgctaataccgcatacgatctgtggatgaaagcgggggaccttcgggcctcgcgcgattggagcggccgatgtcagattaggtagttggtggggtaaaggctcaccaagccgacgatctgtagctggtctgagaggacgaccagccacactgggactgagacacggcccagactcctacgggaggcagcagtggggaattttggacaatgggggcaaccctgatccagcaatgccgcgtgcaggaagaaggccttcgggttgtaaactgcttttgtacggaacgaaaaggctctggttaatacctggggcacatgacggtaccgtaagaataagcaccggctaactacgtgccagcagccgcggtaatacgtagggtgcaagcgttaatcggaattactgggcgtaaagcgtgcgcaggcggtgctgtaagacaggcgtgaaatccccgggcttaacctgggaatggcgcttgtgactgcagtgctggagtgtggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttttctgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagttgccagagatggcttcgtgctcgaaagagagccgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttataggtggggctacacacgtcatacaatggccggtacaaagggcagccaacccgcgagggggagccaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggtctcgccagaagtaggtagcctaaccgcaaggagggcgcttaccacggcggggttcgtgactggggtgaagtcgtaacaaggtagccgtatcggaaggtgcggctggatcacctcctttctg

SEQ ID NO: 4311 - DNA, 1537 bp, Hydrogenophaga sp. NH-16
  ref <308>: DATABASE ACCESSION NUMBER: NCBI ACCESSION: NZ_CP029344.1
  ref <309>: DATABASE ENTRY DATE: 2019-04-01
  ref <313>: RELEVANT RESIDUES IN SEQ ID NO: (1)..(1537)
agatcgaactaaagagtttgatcctggctcagattgaacgctggcggcatgctttacacatgcaagtcgaacggtaacaggccgcaaggtgctgacgagtggcgaacgggtgagtaatgcatcggaacgtgcccagtcgtgggggataacgcagcgaaagctgtgctaataccgcatacgatctatggatgaaagcgggggaccgtaaggcctcgcgcgattggagcggccgatgtcagattaggtagttggtggggtaaaggcctaccaagccaacgatctgtagctggtctgagaggacgaccagccacactgggactgagacacggcccagactcctacgggaggcagcagtggggaattttggacaatgggcgcaagcctgatccagcaatgccgcgtgcaggaagaaggccttcgggttgtaaactgcttttgtacggaacgaaacggtctgggttaataccctggactaatgacggtaccgtaagaataagcaccggctaactacgtgccagcagccgcggtaatacgtagggtgcaagcgttaatcggaattactgggcgtaaagcgtgcgcaggcggttttgtaagacaggcgtgaaatccccgggctcaacctgggaattgcgcttgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaatttactttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatggcaggaagtttccagagatggattcgtgctcgaaagagaacctgcacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggccggtacaaagggcagccaacccgcaagggggagccaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggtctcgccagaagtagttagcctaaccgcaaggagggcgattaccacggcggggttcgtgactggggtgaagtcgtaacaaggtagccgtatcggaaggtgcggctggatcacctcctttctg

SEQ ID NO: 4312 - DNA, 1553 bp, Hydrogenophilus thermoluteolus
  ref <308>: DATABASE ACCESSION NUMBER: NCBI ACCESSION: NZ_AP018558.1
  ref <309>: DATABASE ENTRY DATE: 2019-04-01
  ref <313>: RELEVANT RESIDUES IN SEQ ID NO: (1)..(1553)
gattgaacctgagagtttgatcctggctcagattgaacgctggcggcatgccttacacatgcaagtcgaacggcatcgcgggaaagcttgctttcctggcggcgagtggcgaacgggtgagtaacacatcggaacgtaccggctagtgggggataacccgtcgaaagacgggctaataccgcatacgctcttaggaggaaagcaggggacctttgggccttgcgctagccgagcggccgatgtccgattagctagttggtggggtaaaggcctaccaaggcgacgatcggtagcgggtctgagaggacgatccgccacactgggactgagacacggcccagactcctacgggaggcagcagtggggaatcttggacaatgggggcaaccctgatccagcaatgccgcgtgggtgaagaaggccttcgggttgtaaagccctttcggcagggaagaaatcggcggggcgaataaccctgctggatgacggtacctgcagaagaagcaccggctaactacgtgccagcagccgcggtaatacgtagggtgcgagcgttaatcggatttactgggcgtaaagcgtgcgcaggcggcccgttaagacaggtgtgaaatccctgggctcaacctaggaattgcgcttgtgactggcgggctcgagtacggtagaggggggtggaattcctggtgtagcagtgaaatgcgtagagatcaggaggaacaccgatggcgaaggcagccccctgggcctgtactgacgctcatgcacgaaagcgtggggagcaaacaggattagataccctggtagtccacgccctaaacgatgggtactagccgtttggtgcgcgatagcgctgagtggcgaagctaacgcgtgaagtaccccgcctggggagtacggccgcaaggttgaaactcaaaggaattgacggggacccgcacaagcggtggatgatgtggattaattcgatgcaacgcgaagaaccttacctacccttgacatgccccgaacctgggagagatcctggggtgcccgaaagggaacggggacacaggtgctgcatggctgtcgtcagctcgtgtcgtgagatgttgggttaagtcccgcaacgagcgcaacccctgccattagttgccagcggcttggccgggcactctaatgggactgccggtgacaaaccggaggaaggtggggacgacgtcaagtcatcatggcccttatgggtagggcttcacacgtcatacaatggcgcgtacagagggttgcgaagccgcgaggcggagccaatcccagaaagcgcgtcgtagtccggattgcagtctgcaactcgactgcatgaagtcggaatcgctagtaatcgcggatcagcatgccgcggtgaatacgttcccgggtcttgtacacaccgcccgtcacaccatgggagtggggtgcaccagaagtcggtagcctaaccgcaaggagggcgccgcccacggtgtgctccatgactggggtgaagtcgtaacaaggtagcagtaccggaaggtgcggctggatcacctcctttcaag

SEQ ID NO: 4313 - DNA, 1534 bp, Hydrogenothermus marinus
  ref <308>: DATABASE ACCESSION NUMBER: NCBI ACCESSION: NZ_REFO01000007.1
  ref <309>: DATABASE ENTRY DATE: 2019-04-01
  ref <313>: RELEVANT RESIDUES IN SEQ ID NO: (1)..(1534)
actggagagtttgatcctggctcagcgcgaacgttggcggcgtgcctaacacatgcaagtcgtggggcagcaggccttcccttttgggaaggtgctggcgaccggcgaacgggtgagtaacgcgtagctaacctaccctaaggatggggataaccccccgaaaggggggctaatacccaataaagaggcttattgaatgatgagcctccaaaggccgcaaggcgccttaggatggggctgcgtcccatcagctagttggtgaggtaaaagctcaccaaggctacgacgggtagctggtctgagaggatggccagccacagtgggactgagacacggcccgcacccctacggggggcagcagtggggaatattgggcaatggccgaaaggctgacccagcaacgccgcgtggtggaagaagcccttcggggtgtaaacacctgtcagtggggaagataatgacggtacccacagaggaagggacggctaactacgtgccagcagccgcggtaatacgtaggtcccgaacgttgcgcgaatttactgggcgtaaagggtccgtaggcggtctggtaagtggaaggtgaaatcctggggctcaactccagaattgccttccaaactgctggacttgaggcagggagaggtcggcggaattcccggtgtagcggtgaaatgcgtagatatcgggaggaacaccagtggcgaaggcggccgactggaactgtcctgacgctgagggacgaaagccaggggagcgaaccggattagatacccgggtagtcctggccgtaaacgatggatgctagatgtgggcagggaaacctgtccgtgtcgcaagctaacgcgttaagcatcccgcctggggagtacgaccgcaaggttgaaactcaaaggaattgacggggacccgcacaaccggtggagcgtctggtttaattcgatgctaaccgaaaaacctcaccagggcttgacatgcggtgtgtcgtggccgaaaggtcactagggtacccttatgggtacccgcgccgcacaggtggtgcatggtcgtcgtcagctcgtgtcgtgagatgttgggttaagtcccgcaacgagcgcaacccttgccctgtgttaccagcgggtaaagccgggtactcacaggggactgccggcgataagccggaggaaggaggggatgacgtcagatcagtatgccctttatgccctgggctacacaggcgctacaatggcagggacaaagggaagcgaagccgcaaggtggagcaaaccccaaaaaccctgtcgtagtgcggattgggggttgcaactcacccccatgaaggcggaatcggtagtaatggcgaatcagcaatgtcgccgtgaatacgttctcgggtcttgtacacaccgcccgtcacgccacgggagttgggtccatcggaagtccccgggccaacccgcaagggaggcaggggccgatgatgggcctggcgactggggcgaagtcgtaacaaggtagccgtaggggaacctgcggctggatcacctccttt

SEQ ID NO: 4314 - DNA, 1562 bp, Hydrogenovibrio thermophilus
  ref <308>: DATABASE ACCESSION NUMBER: NCBI ACCESSION: NZ_CP035033.1
  ref <309>: DATABASE ENTRY DATE: 2019-04-01
  ref <313>: RELEVANT RESIDUES IN SEQ ID NO: (1)..(1562)
taaactgaagagtttgatcctggctcagaatgaacgctggcggcaggcctaacacatgcaagtcgaacggaaacgacaagaacaaactcttcggagggcgatcttgggcgtcgagtggcggacgggtgagtaacgcgtgggaatctaccctttagttggggacaacatatggaaacgtatgctaataccgaatatgctctacggagtaaaggtggcctctacttgtaagctatcgctaaaggatgagcccgcgttagattagctagttggtggggtaaaggcctaccaaggcgacgatctatagctggtttgagaggatgatcagccacactgggactgagacacggcccagactcctacgggaggcagcagtggggaatattgcacaatgagggaaaccttgatgcagccatgccgcgtgtgtgaagaaggcccgagggttgtaaagcactttcaattgtgaggaaaggttagtcgctaatatcggctagctgtgacgttaactttagaagaagcaccggctaactctgtgccagcagccgcggtaatacagagggtgcaagcgttattcggaattactgggcgtaaagcgcgcgtaggcggactgttaagtcggttgtgaaagccctgggctcaacctaggaattgcatccgatactggcaatctagagtttaggagagggaagtggaattcctggtgtagcagtgaaatgcgtagatatcaggaggaacatcagtggcgaaggcgacttcctggcctaaaactgacgctgaggtgcgaaagcgtgggtagcgaacgggattagataccccggtagtccacgccgtaaacgatgtcaactagctgttggccttattaaaaaggttagtagcgtagctaacgcgctaagttgaccgcctggggagtacggtcgcaagattaaaactcaaaggaattgacgggggcccgcacaagcggtggagcatgtggtttaattcgatgcaacgcgaagaaccttaccatcccttgacatcctgcgaactttctagagatagattggtgccttcgggaacgcagtgacaggtgctgcatggctgtcgtcagctcgtgtcgtgagatgttgggttaagtcccgcaacgagcgcaacccttatctttagttgctaccatttagttgagaactctaaagagactgccggtgataaaccggaggaaggcggggacgacgtcaagtcatcatggcccttatgggatgggctacacacgtgctacaatggggggtacaaagagcagctagctggcgacagtgcgcgaatctcataaaacctctcgtagtccggatcggagtctgcaactcgactccgtgaagtcggaatcgctagtaatcgtgaatcagaatgtcacggtgaatacgttcccgggccttgtacacaccgcccgtcacaccatgggagtgggttgcaaaagaagtgggtagtctaaccttcgggagggcgctcaccactttgtgattcatgactggggtgaagtcgtaacaaggtagccctagcggaagctggggctggatcacctcctttaagac

SEQ ID NO: 4315 - DNA, 1537 bp, Hydrotalea sandarakina
  ref <308>: DATABASE ACCESSION NUMBER: NCBI ACCESSION: NZ_QKZV01000003.1
  ref <309>: DATABASE ENTRY DATE: 2019-04-01
  ref <313>: RELEVANT RESIDUES IN SEQ ID NO: (1)..(1537)
tacaatggagagtttgatcctggctcaggatgaacgctagcggcaggcttaatacatgcaagtcgaggggcagcacagtatagcaatatatgggtggcgaccggcaaacgggtgcggaacacgtacacaaccttccgataagagggggatagcccagagaaatttggattaataccccgtaagataaagttcaggcatctggattttatgataggcgcgagccgcttattgatgggtgtgcgtctgattaggtagttggcggggtaaaggcccaccaagcctacgatcagtagctgatgtgagagcatgatcagccacacgggcactgagacacgggcccgactcctacgggaggcagcagtaaggaatattggacaatggacggaagtctgatccagccatgccgcgtgaaggatgaatgccctctgggttgtaaacttcttttataggggaagaaagatacttttttgaaggtagttgacggtaccctatgaataagcaccggctaactccgtgccagcagccgcggtaatacggagggtgcaagcgttatccggatttactgggtttaaagggtgcgtaggcgggcatgtaagtcagtggtgaaataccggagcttaacttcggaactgccattgatactatatgtcttgaatattgtggaggtaagcggaatatgtcatgtagcggtgaaatgcatagatatgacatagaacaccgattgcggaggcagcttgctacgcaaatattgacgctgaggcacgaaagcgtggggagcaaacaggattagataccctggtagtccacgccctaaacgatgattactcgacattagcgataaacagttagtgtctgagcgaaagcattaagtaatccacctgggaagtacgaccgcaaggttgaaactcaaaggaattggcgggggtccgcacaagcggtggagcatgtggtttaattcgatgatacgcgaggaaccttacctgggctagaatgccacttgacagccggtgaaagctggttttgtagcaatacacaggtggtaaggtgctgcatggctgtcgtcagctcgtgccgtgaggtgttgggttaagtcccgcaacgagcgcaacccctatcggtagttgccaacaggtaaagctgggaactctactgaaactgccgccgtaaggcgagaggaaggaggggatgatgtcaagtcatcatggcctttatgcccagggctacacacgtgctacaatggggaggacaaagggcagcgacacagtgatgtgaagccaatcccaaaaacctcttctcagttcagattggagtctgcaactcgactccatgaagctggaatcgctagtaatcgtatatcagcaatgatacggtgaatacgttcccggaccttgcacacaccgcccgtcaagccatgggagccgggtgtacctaaagtcggtaaccgcaaggagctgcctagggtaaaactggtgactggggctaagtcgtaacaaggtagccgtaccggaaggtgcggctggaatacctccttttagag

SEQ ID NO: 4316 - DNA, 378 bp, Hymenobacter aerophilus
  ref <308>: DATABASE ACCESSION NUMBER: NCBI ACCESSION: NZ_KB907846.1
  ref <309>: DATABASE ENTRY DATE: 2019-04-01
  ref <313>: RELEVANT RESIDUES IN SEQ ID NO: (1)..(378)
ttacaatggagagtttgatcctggctcaggatgaacgctagcggcaggcctaatacatgcaagtcgaacgggtagtagcaatactactagtggcgcacgggtgcgtaacgcgtaaccaatctgccctgaactgggggatagcccgccgaaaggcggattaataccgcataaaccaacagaacggcatcgtttaattggtaaagatttattggttcaggatgaggttgcgtgccattagctagttggcggggtaaaggcccaccaaggcgacgatggctaggggacctgagagggtgatcccccacactggcactgagatacgggccagactcctacgggaggcagcagtagggaatattgggcaatggacgagagtct

SEQ ID NO: 4317 - DNA, 1511 bp, Hymenobacter amundsenii
  ref <308>: DATABASE ACCESSION NUMBER: NCBI ACCESSION: NZ_NIRR01000089.1
  ref <309>: DATABASE ENTRY DATE: 2019-04-01
  ref <313>: RELEVANT RESIDUES IN SEQ ID NO: (1)..(1511)
tggagagtttgatcctggctcaggatgaacgctagcggcaggcctaatacatgcaagtcgaacgggtgtagcaatacactagtggcgcacgggtgcgtaacgcgtaaccaacctgcccttgactgggggatagcccgccgaaaggcggattaataccgcataaaccaacagcccggcatcgggcaattggtaaagatttattggtcaaggatggggttgcgtagcattagctagttggcggggtaacggcccaccaaggcgacgatgcttaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaaggggatgcgtcctcaactgacggtacctgaggaataagcaccggctaactccgtgccagcagccgcggtaatacggagggtgcaagcgttgtccggatttattgggtttaaagggtgcgtaggcggcttgttaagtccggggtgaaagcccacagctcaactgtggaactgccctggatactggcaagcttgagtccagacgaggttggcggaatggaaggtgtagcggtgaaatgcatagataccttccagaaccccgattgcgtaggcagctgactaggctggtactgacgctgaggcacgaaagcgtggggagcgaacaggattagataccctggtagtccacgccgtaaacgatggatactcgctggtagcgatatactgttactggcttagcgaaagcggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggtccagagatggatctttccttcgggacacaaagcaaggtgctgcatggccgtcgtcagctcgtgccgtgaggtgttgggttaagtcccgcaacgagcgcaacccctatgtttagttgccagcacgtaatggtggggactctagacagactgcctgcgcaagcagtgaggaaggcggggacgacgtcaggtcatcatggcccttacgcctagggctacacacgtgctacaatgggcggtacagcgggttgctactgggtgaccagatgccaatctcaaaaaaccgttctcagttcggatcggagtctgcaactcgactccgtgaagctggaatcactagtaatcgcgtatcagcaatgacgcggtgaatacgttcccgggccttgtacacaccgcccgtcaagccatggaagtttggtagacctgaagctggtgctccgcaacgaagccagttagggtagaacaagtaactagggctaagtcgtaacaaggtagccgtaccggaaggtgcggctggatcacctcctttct

SEQ ID NO: 4318 - DNA, 1512 bp, Hymenobacter coccineus
  ref <308>: DATABASE ACCESSION NUMBER: NCBI ACCESSION: NZ_MDZA01000272.1
  ref <309>: DATABASE ENTRY DATE: 2019-04-01
  ref <313>: RELEVANT RESIDUES IN SEQ ID NO: (1)..(1512)
tggagagtttgatcctggctcaggatgaacgctagcggcaggcctaatacatgcaagtcgaacggtggcagcaatgccatagtggcgcacgggtgcgtaacgcgtagccaacctacccagatctgggggatagcccgccgaaaggcggattaataccgcataagacaatagagcggcatcgcttagttgttaaagatttattggatttggatggggctgcgtgccattagctagttgggggggtaacggcccaccaaggcgacgatggctaggggagctgagaggctggtcccccacacgggcactgagatacgggcccgactcctacgggaggcagcagtagggaatattgggcaatggcggaaacgctgacccagccatgccgcgtgccggatgaaggccttctgggtcgtaaacggcttttttccgggaagaaccggtcctgtgcgcagggccctgacggtaccgggagaataagcaccggctaactccgtgccagcagccgcggtaatacggagggtgcgagcgttgtccggatttattgggtttaaagggtgcgtaggcggccgcgtaagtctggggtgaaagcccgttgctcaacaacggaactgccctggaaactgcgcggcttgagtacagacgaggttggcggaatgggcggtgtagcggtgaaatgcatagataccgtccagaacaccgattgcgaaggcagctgactaggctgttactgacgctgaggcacgaaagcgtggggagcgaacaggattagataccctggtagtccacgccgtaaacgatggatactcgctgccagcgatagacagttggtggcttagcgaaagcgttaagtatcccacctggggagtacgcccgcaagggtgaaactcaaaggaattgacgggggcccgcacaagtggtggagcatgtggtttaattcgatgatacgcgaggaaccttacctaggctagaatgcgcgtgaccggttcggagacgaacctttccttcgggacacaaagcaaggtgctgcatggccgtcgtcagctcgtgccgtgaggtgttgggttaagtcccgcaacgagcgcaacccctatgtttagttgccagcgggtcaagccggggactctagacagactgcctgcgcaagcagtgaggaaggcggggacgacgtcaggtcatcatggcccttacgcctagggctacacacgtgctacaatggacggtacagcgggttgccaaccagcgatggtgcgccaatcccgaaaagccgttctcagttcggatcggagtctgcaactcgactccgtgaagctggaatcactagtaatcgcgcatcagcaatggcgcggtgaatacgttcccgggccttgtacacaccgcccgtcaagccatggaagtttggtagacctgaagccggtgctccgcaacgaagccggttagggtagaacaggtaactagggctaagtcgtaacaaggtagccgtaccggaaggtgcggctggatcacctcctttct

SEQ ID NO: 4319 - DNA, 1518 bp, Hymenobacter daecheongensis
  ref <308>: DATABASE ACCESSION NUMBER: NCBI ACCESSION: NZ_FQYN01000018.1
  ref <309>: DATABASE ENTRY DATE: 2019-04-01
  ref <313>: RELEVANT RESIDUES IN SEQ ID NO: (1)..(1518)
tacaatggagagtttgatcctggctcaggatgaacgctagcggcaggcctaatacatgcaagtcgaacggggtgtagcaatacatctagtggcgcacgggtgcgtaacgcgtaaccaacctacccgaaactgggggatagcccgccgaaaggcggattaataccgcataagaccacagcgcggcatcgcgcaggggttaaagatttattggtttcggatggggttgcgtagcattagctagttggcggggtagaggcccaccaaggcgacgatgcttaggggacctgagagggtgatcccccacactggcactgagatacgggccagactcctacgggaggcagcagtagggaatattgggcaatggccgagaggctgacccagccatgccgcgtgccggatgaaggccttctgggttgtaaacggcttttctcagggaagaaaaaggggatgcgtcccaaactgacggtacctgaggaataagcaccggctaactccgtgccagcagccgcggtaatacggagggtgcaagcgttgtccggatttattgggtttaaagggtgcgtaggtggccttgcaagtccgtggtgaaagcctgctgctcaacagcagaactgccatggatactacagggcttgagtccagacgaggttggcggaatggaagatgtagcggtgaaatgcatagatatcttccagaaccccgattgcgtaggcagctgactaggctggtactgacactgaggcacgaaagcgtggggagcgaacaggattagataccctggtagtccacgccgtaaacgatggatactcgttgcaggcgatacacagtctgtgacttagcgaaagcgttaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggttcagagatgagcctttccttcgggacacaaagcaaggtgctgcatggccgtcgtcagctcgtgccgtgaggtgttgggttaagtcccgcaacgagcgcaacccctatgtttagttgccagcacatgatggtggggactctaaacagactgcctgcgcaagcagtgaggaaggcggggacgacgtcaggtcatcatggcccttacgcctagggctacacacgtgctacaatggacggtacagagggtcgctactgggcaaccagatgccaatctcacaaagccgttctcagttcggatcggagtctgcaactcgactccgtgaagctggaatcactagtaatcgcgtatcagcaatgacgcggtgaatacgttcccgggccttgtacacaccgcccgtcaagccatggaagtttggtagacctgaagctggtgctcgtcacagaagccagttagggtagaacaagtaactggggctaagtcgtaacaaggtagccgtaccggaaggtgcggctggatcacctcctttct

SEQ ID NO: 4320 - DNA, 737 bp, Hymenobacter glacialis
  ref <308>: DATABASE ACCESSION NUMBER: NCBI ACCESSION: NZ_MDZC01000117.1
  ref <309>: DATABASE ENTRY DATE: 2019-04-01
  ref <313>: RELEVANT RESIDUES IN SEQ ID NO: (1)..(737)
tggtagtccacgccgtaaacgatggatactcgctgccggcgatacaatgtcggtggcttagcgaaagcgttaagtatcccacctggggagtacgctcgcaagagtgaaactcaaaagaattgacgggggcccgcacaagtggtggagcatgtggtttaattcgatgatacgcgaggaaccttacctaggctagaatgcgcgtgaccggcccagagatgggcctttccttcgggacacaaagcaaggtgctgcatggccgtcgtcagctcgtgccgtgaggtgttgggttaagtcccgcaacgagcgcaacccctatggttagttgccagcacgtaatggtggggactctagccagactgcctgcgcaagcagtgaggaaggcggggacgacgtcaggtcatcatggcccttacgcctagggctacacacgtgctacaatggacggtacagcgggttgccaaccagcgatggtgcgccaatcccgaaaagccgttctcagttcggatcggagtctgcaactcgactccgtgaagctggaatcactagtaatcgcgtatcagcaatgacgcggtgaatacgttcccgggccttgtacacaccgcccgtcaagccatggaagtttggtagacctgaagctggtgctccgcaacgaagccagttagggtagaacaggtaactagggctaagtcgtaacaaggtagccgtaccggaaggtgcggctggatcacctcctttct

SEQ ID NO: 4321 - DNA, 1348 bp, Hymenobacter gummosus
  ref <308>: DATABASE ACCESSION NUMBER: NCBI ACCESSION: NZ_RXOF01000027.1
  ref <309>: DATABASE ENTRY DATE: 2019-04-01
  ref <313>: RELEVANT RESIDUES IN SEQ ID NO: (1)..(1348)
acactgcagggcggcatcgcccaacagttaaagaatttcggagatagatgagcctgcgtgccattagctagttggtgaggtaacggctcaccaaggcgacgatggctaggggagctgagaggccgatcccccacactggcactgagatacgggccagactcctacgggaggcagcagtagggaatattgggcaatgggcgcgagcctgacccagccatgccgcgtgacggatgaaggccttctgggttgtaaacgtcttttgaccgggaagaaaacgcccttgcgagggaaatcgacggtaccggttgaataagcaccggctaactccgtgccagcagccgcggtaatacggagggtgcgagcgttgtccggatttattgggtttaaagggtgcgtaggtggccctgcaagtccgtggtgaaagcctgctgctcaacagcagaactgccatggatactacagggcttgagtccagacgaggttggcggaatggatggtgtagcggtgaaatgcatagataccatccagaaccccgattgcgtaggcagctgactaggctggtactgacactgaggcacgaaagcgtggggagcgaacaggattagataccctggtagtccacgccgtaaacgatggatactcgctgtgggcgatacacagtccgcggcttagcgaaagcgttaagtatcccacctggggagtacgccggcaacggtgaaactcaaaggaattgacgggggcccgcacaagtggtggagcatgtggtttaattcgatgatacgcgaggaaccttaccgaggctagaatgcgcgtgaccggttcagagatggacctttccttcgggacacaaagcaaggtgctgcatggccgtcgtcagctcgtgccgtgaggtgttgggttaagtcccgcaacgagcgcaacccctatggttagttgccagcacgtaatggtggggactctagccagactgcctgcgcaagcagcgaggaaggcggggacgacgtcaggtcatcatggcccttacgcctcgggctacacacgtgctacaatggacggtacagagggtcgccacgcagcgatgcggagccaatctcaaaaagccgttctcagttcggatcggagtctgcaactcgactccgtgaagctggaatcactagtaatcgcgtatcagcaacgacgcggtgaatacgttcccgggccttgtacacaccgcccgtcaagccatggaagtctggtggacctgaagctggtgctcgtcacagaagccagttagggtaaaacaggtaactggggctaagtcgtaacaaggtagccgtaccggaaggtgcggctggatcacctcctttct

SEQ ID NO: 4322 - DNA, 1437 bp, Hymenobacter lapidarius
  ref <308>: DATABASE ACCESSION NUMBER: NCBI ACCESSION: NZ_MDZB01000021.1
  ref <309>: DATABASE ENTRY DATE: 2019-04-01
  ref <313>: RELEVANT RESIDUES IN SEQ ID NO: (1)..(1437)
atagtggcgcacgggtgcgtaacgcgtaaccaacctacccgaatctgggggatagcccgccgaaaggcggattaataccgcataaaacggcagaccggcatcggttcaccgttaaagatttattggattcggatggggttgcgtgccattagctagttgggggggtaacggcccaccaaggcgacgatggctaggggagctgagaggctggtcccccacacgggcactgagatacgggcccgactcctacgggaggcagcagtagggaatattgggcaatgggcgagagcctgacccagccatgccgcgtgcaggacgaaggctttctgagtcgtaaactgcttttgccagggaagaataagggggatgcgtcctccgacgacggtacctggtgaataagcaccggctaactccgtgccagcagccgcggtaatacggagggtgcaagcgttgtccggatttattgggtttaaagggtgcgtaggcggctttttaagtccggggtgaaagcccgttgctcaacaacggaactgccccggaaactggagagcttgagtacagacgagggcggcggaatggagggtgtagcggtgaaatgcatagataccctccagaaccccgattgcgaaggcagctgcctagactgtaactgacgctgaggcacgaaagcgtggggagcgaacaggattagataccctggtagtccacgccgtaaacgatggatactcgctgccggcgatacaatgtcggtggcttagcgaaagcgttaagtatcccacctggggagtacgctcgcaagagtgaaactcaaaagaattgacgggggcccgcacaagtggtggagcatgtggtttaattcgatgatacgcgaggaaccttacctaggctagaatgcgcgtgaccggcccagagatgggcctttccttcgggacacaaagcaaggtgctgcatggccgtcgtcagctcgtgccgtgaggtgttgggttaagtcccgcaacgagcgcaacccctatggttagttgccagcacgtaatggtggggactctagccagactgcctgcgcaagcagtgaggaaggcggggacgacgtcaggtcatcatggcccttacgcctagggctacacacgtgctacaatggacggtacagcgggttgccaaccagcgatggtgcgccaatcccgaaaagccgttctcagttcggatcggagtctgcaactcgactccgtgaagctggaatcactagtaatcgcgcatcagcaatggcgcggtgaatacgttcccgggccttgtacacaccgcccgtcaagccatggaagtttggtagacctgaagctggtgctccgcaacgaagccagttagggtagaacaggtaactagggctaagtcgtaacaaggtagccgtaccggaaggtgcggctggatcacctcctttctgga

SEQ ID NO: 4323 - DNA, 1514 bp, Hymenobacter nivis
  ref <308>: DATABASE ACCESSION NUMBER: NCBI ACCESSION: NZ_CP029145.1
  ref <309>: DATABASE ENTRY DATE: 2019-04-01
  ref <313>: RELEVANT RESIDUES IN SEQ ID NO: (1)..(1514)
tggagagtttgatcctggctcaggatgaacgctagcggcaggcctaatacatgcaagtcgaacggtttgtagcaatacaaatagtggcgcacgggtgcgtaacgcgtagccaacctacccgaatctgggggatagcccgccgaaaggcggattaataccgcataagactatgagccggcatcggttgatagttaaagatttattggattcggatggggctgcgtgccattagctagttggcggggtaacggcccaccaaggcgacgatggctaggggagctgagaggctggtcccccacacgggcactgagatacgggcccgactcctacgggaggcagcagtagggaatattgggcaatgggcgagagcctgacccagccatgccgcgtgccggatgaaggccttctgggtcgtaaacggcttttttccgggaagaaccggttccttgcgaggggctctgacggtaccgggagaataagcaccggctaactccgtgccagcagccgcggtaatacggagggtgcgagcgttgtccggatttattgggtttaaagggtgcgtaggcggccgcgtaagtctggggtgaaagcccgttgctcaacaacggaactgccctggaaactgcgtggcttgagtccagacgaggttggcggaatgggcggtgtagcggtgaaatgcatagataccgtccagaacaccgattgcgaaggcagctgactaggctggtactgacgctgaggcacgaaagcgtggggagcgaacaggattagataccctggtagtccacgccgtaaacgatggatactcgctgccagcgatagatggttggtggcttagcgaaagcgttaagtatcccacctggggagtacgcccgcaagggtgaaactcaaaggaattgacgggggcccgcacaagtggtggagcatgtggtttaattcgatgatacgcgaggaaccttacctaggctagaatgcgcgtgaccggttcggagacgaacctttccttcgggacacaaagcaaggtgctgcatggccgtcgtcagctcgtgccgtgaggtgttgggttaagtcccgcaacgagcgcaacccctatgtttagttgccagcgggttaagccggggactctagacagactgcctgcgcaagcagtgaggaaggcggggacgacgtcaggtcatcatggcccttacgcctagggctacacacgtgctacaatggacggtacagcgggttgccaaccagcgatggtgcgccaatcccgaaaagccgttctcagttcggatcggagtctgcaactcgactccgtgaagctggaatcactagtaatcgcgcatcagcaatggcgcggtgaatacgttcccgggccttgtacacaccgcccgtcaagccatggaagtttggtagacctgaagccggtgctccgcaacgaagccggttagggtagaacaggtaactagggctaagtcgtaacaaggtagccgtaccggaaggtgcggctggatcacctcctttct

SEQ ID NO: 4324 - DNA, 771 bp, Hymenobacter norwichensis
  ref <308>: DATABASE ACCESSION NUMBER: NCBI ACCESSION: NZ_ATVL01000009.1
  ref <309>: DATABASE ENTRY DATE: 2019-04-01
  ref <313>: RELEVANT RESIDUES IN SEQ ID NO: (1)..(771)
tacaatggagagtttgatcctggctcaggatgaacgctagcggcaggcctaatacatgcaagtcgaacggatgtagcaatacactagtggcgcacgggtgcgtaacgcgtaaccaacctacctacaactgggggatagcccgccgaaaggcggattaataccgcataaaccagcagcctggcatcaggtaattggtaaagatttattggttgtagatggggttgcgtagcattagctagatggcggggtaacggcccaccatggcgacgatgcttaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaagaccttgcgaggtacactgacggtacctgaggaataagcaccggctaactccgtgccagcagccgcggtaatacggagggtgcaagcgttgtccggatttattgggtttaaagggtgcgtaggtggcttgttaagtccggggtgaaagcccacagctcaactgtggaactgccctggatactggcgagcttgagtccagacgaggttggcggaatggaagctgtagcggtgaaatgcatagatagcatccagaaccccgattgcgtaggcagctgactaggctggtactgacactgaggcacgaaagcgtggggagcgaacaggatt

SEQ ID NO: 4325 - DNA, 1513 bp, Hymenobacter perfusus
  ref <308>: DATABASE ACCESSION NUMBER: NCBI ACCESSION: NZ_RWIU01000017.1
  ref <309>: DATABASE ENTRY DATE: 2019-04-01
  ref <313>: RELEVANT RESIDUES IN SEQ ID NO: (1)..(1513)
tggagagtttgatcctggctcaggatgaacgctagcggcaggcctaatacatgcaagtcgaacgggtggtagcaataccactagtggcgcacgggtgcgtaacgcgtaaccaacctgcccttgactgggggatagcccgccgaaaggcggattaataccgcataaactagcagcctggcatcaggcaactagtaaagatttattggtcaaggatggggttgcgtgacattagctagttggcggggtaacggcccaccaaggcgacgatgtctaggggacctgagagggtgatcccccacactggcactgagatacgggccagactcctacgggaggcagcagtagggaatattgggcaatgggcgagagcctgacccagccatgccgcgtgcaggatgaaggccttctgggttgtaaactgcttttctcagggaagaaaaagaggatgcgtcctaaactgacggtacctgaggaataagcaccggctaactccgtgccagcagccgcggtaatacggagggtgcaagcgttgtccggatttattgggtttaaagggtgcgtaggcggcccgttaagtccggggtgaaagcccacagctcaactgtggaactgccctggatactggcgggcttgagtccagacgaggttggcggaatggaaggtgtagcggtgaaatgcatagataccttccagaaccccgattgcgtaggcagctgactaggctggtactgacgctgaggcacgaaagcgtggggagcgaacaggattagataccctggtagtccacgccgtaaacgatggatactcgctggtggcgatagacagtcactggcttagcgaaagcggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggttcagagatgaacttttccttcgggacacaaagcaaggtgctgcatggccgtcgtcagctcgtgccgtgaggtgttgggttaagtcccgcaacgagcgcaacccctacatttagttgccatcaggttaagctggggactctagatggactgcctgcgcaagcagtgaggaaggcggggacgacgtcaggtcatcatggcccttacgcctagggctacacacgtgctacaatggacggtacagagggtcgctacacagtgatgtgatgccaatctcacaaagccgttctcagttcggatcgaagtctgcaactcgacttcgtgaagctggaatcactagtaatcgcgtatcagcaatgacgcggtgaatacgttcccgggccttgtacacaccgcccgtcaagccatggaagtctggtagacctgaagctggtgctccgcaacgaagccagttagggtagaacaggtaactggggctaagtcgtaacaaggtagccgtaccggaaggtgcggctggatcacctcctttct

SEQ ID NO: 4326 - DNA, 1264 bp, Hymenobacter psychrotolerans
  ref <308>: DATABASE ACCESSION NUMBER: NCBI ACCESSION: NZ_FRAS01000056.1
  ref <309>: DATABASE ENTRY DATE: 2019-04-01
  ref <313>: RELEVANT RESIDUES IN SEQ ID NO: (1)..(1264)
ggcccaccaaggcgacgatgcttaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaaggtgatgcgtcacaaactgacggtacctgaggaataagcaccggctaactccgtgccagcagccgcggtaatacggagggtgcaagcgttgtccggatttattgggtttaaagggtgcgtaggcggcccgttaagtccggggtgaaagcctcttgctcaacaagagaactgccctggatactggcgggcttgagtccagacgaggttggcggaatggaaggtgtagcggtgaaatgcatagataccttccagaaccccgattgcgtaggcagctgactaggctggtactgacgctgaggcacgaaagcgtggggagcgaacaggattagataccctggtagtccacgccgtaaacgatggatactcgctggcagcgatagactgttgctggcttagggaaaccggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggttcagagatggacctttccttcgggacacaaagcaaggtgctgcatggccgtcgtcagctcgtgccgtgaggtgttgggttaagtcccgcaacgagcgcaacccctatgtttagttgccatcaggttatgctggggactctaaacagactgcctgcgcaagcagtgaggaaggcggggacgacgtcaggtcatcatggcccttacgcctagggctacacacgtgctacaatggacggtacagagggtcgctacttagtgataagatgccaatctcacaaagccgttctcagttcggattgaagtctgcaactcgacttcatgaagctggaatcactagtaatcgcgtatcagcaatgacgcggtgaatacgttcccgggccttgtacacaccgcccgtcaagccatggaagtttggtagacctgaagctggtgctccgcaacgaagccagttagggtagaacaagtaactggggctaagtcgtaacaaggtagccgtaccggaaggtgcggctggatcacctcctttct

SEQ ID NO: 4327 - DNA, 1511 bp, Hymenobacter rigui
  ref <308>: DATABASE ACCESSION NUMBER: NCBI ACCESSION: NZ_RWIT01000031.1
  ref <309>: DATABASE ENTRY DATE: 2019-04-01
  ref <313>: RELEVANT RESIDUES IN SEQ ID NO: (1)..(1511)
tggagagtttgatcctggctcaggatgaacgctagcggcaggcctaatacatgcaagtcgaacggtggtagcaataccatagtggcgcacgggtgcgtaacgcgtaaccaacctgcccttgactgggggatagcccgccgaaaggcggattaataccgcataaactcgcagtgtggcatcacacaacgagtaaagatttattggtcaaggatggggttgcgtgacattagctagttggcggggtaacggcccaccaaggcgacgatgtctaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaagaggatgcgtcctacactgacggtacctgaggaataagcaccggctaactccgtgccagcagccgcggtaatacggagggtgcaagcgttgtccggatttattgggtttaaagggtgcgtaggcggcccgttaagtccggggtgaaagcccactgctcaacagtggaactgccctggatactggcgggcttgagtccagacgaggttggcggaatggatgctgtagcggtgaaatgcatagatagcatccagaaccccgattgcgtaggcagctgactaggctggtactgacgctgaggcacgaaagcgtggggagcgaacaggattagataccctggtagtccacgccgtaaacgatggatactcgctggtggcgatagacagtcactggcttagcgaaagcggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggttcagagatgaacttttccttcgggacacaaagcaaggtgctgcatggccgtcgtcagctcgtgccgtgaggtgttgggttaagtcccgcaacgagcgcaacccctacatttagttgccatcaggttaagctggggactctagatggactgcctgcgcaagcagtgaggaaggcggggacgacgtcaggtcatcatggcccttacgcctagggctacacacgtgctacaatggacggtacagagggtcgctacacagtgatgtgatgccaatctcacaaagccgttctcagttcggatcgaagtctgcaactcgacttcgtgaagctggaatcactagtaatcgcgtatcagcaatgacgcggtgaatacgttcccgggccttgtacacaccgcccgtcaagccatggaagtctggtagacctgaagctggtgctccgcaacgaagccagttagggtagaacaggtaactggggctaagtcgtaacaaggtagccgtaccggaaggtgcggctggatcacctcctttct

SEQ ID NO: 4328 - DNA, 1520 bp, Hymenobacter roseosalivarius
  ref <308>: DATABASE ACCESSION NUMBER: NCBI ACCESSION: NZ_FWWW01000005.1
  ref <309>: DATABASE ENTRY DATE: 2019-04-01
  ref <313>: RELEVANT RESIDUES IN SEQ ID NO: (1)..(1520)
acaatggagagtttgatcctggctcaggatgaacgctagcggcaggcctaatacatgcaagtcgaacgggtggtagcaatatcactagtggcgcacgggtgcgtaacgcgtaaccaacctacccaccactgggggatagcccgccgaaaggcggattaataccgcatactataaggcgacggcatcgtcgttttataaaagatttattggtggtggatggggttgcgtagcattagctagatggcggggtaacggcccaccatggcgacgatgcttaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaagaggatgcgtcctaaactgacggtacctgaggaataagcaccggctaactccgtgccagcagccgcggtaatacggagggtgcaagcgttgtccggatttattgggtttaaagggtgcgtaggtggcttgttaagtccggggtgaaagcccacagctcaactgtggaactgccctggatactggcaggcttgagagtagtcgagggtggcggaatggacggtgtagcggtgaaatgcatagataccgtccagaaccccaattgcgtaggcagctgcctaggctacatctgacactgaggcacgaaagcgtggggagcgaacaggattagataccctggtagtccacgccgtaaacgatggatactcgttgccagcgatagactgttggtgacttagcgaaagcggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggctcagagatgagcctttccttcgggacacaaagcaaggtgctgcatggccgtcgtcagctcgtgccgtgaggtgttgggttaagtcccgcaacgagcgcaacccctacttttagttgccagcatgtaatgatggggactctagaaggactgcctgcgcaagcagtgaggaaggcggggacgacgtcaggtcatcatggcccttacgcctagggctacacacgtgctacaatggccggtacagagggtcgctactgcgcgagcagacgccaatctcacaaaaccggtctcagttcggatcggagtctgcaactcgactccgtgaagctggaatcactagtaatcgcgtatcagcaatgacgcggtgaatacgttcccgggccttgtacacaccgcccgtcaagccatggaagtctggtagacctgaagctggtgctcgtcacagaagccagttagggtagaacaggtaactggggctaagtcgtaacaaggtagccgtaccggaaggtgcggctggatcacctcctttctgga

SEQ ID NO: 4329 - DNA, 1511 bp, Hymenobacter rubripertinctus
  ref <308>: DATABASE ACCESSION NUMBER: NCBI ACCESSION: NZ_QYCN01000074.1
  ref <309>: DATABASE ENTRY DATE: 2019-04-01
  ref <313>: RELEVANT RESIDUES IN SEQ ID NO: (1)..(1511)
tggagagtttgatcctggctcaggatgaacgctagcggcaggcctaatacatgcaagtcgaacggttctagcaatagaatagtggcgcacgggtgcgtaacgcgtaaccaacctgcccttgactgggggatagcccgccgaaaggcggattaataccgcataagactatagaacggcatcgtttcgtagttaaagatttattggtcaaggatggggttgcgtagcattagctagttggcggggtaacggcccaccaaggcgacgatgcttaggggacctgagagggtgatcccccacactggcactgagatacgggccagactcctacgggaggcagcagtagggaatattgggcaatgggcgagagcctgacccagccatgccgcgtgcaggatgaaggccttctgggttgtaaactgcttttctcagggaagaaaaagaccatgcgtggtacactgacggtacctgaggaataagcaccggctaactccgtgccagcagccgcggtaatacggagggtgcaagcgttgtccggatttattgggtttaaagggtgcgtaggcggcccgttaagtccggggtgaaagcccacagctcaactgtggaactgccctggatactgacgggcttgagtccagacgaggttggcggaatggaaggtgtagcggtgaaatgcatagataccttccagaaccccgattgcgtaggcagctgactaggctggtactgacgctgaggcacgaaagcgtggggagcgaacaggattagataccctggtagtccacgccgtaaacgatggatactcgctggtggcgatagacagtcactggcttagcgaaagcggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggttcagagatggacttttccttcgggacacaaagcaaggtgctgcatggccgtcgtcagctcgtgccgtgaggtgttgggttaagtcccgcaacgagcgcaacccctatgtttagttgccagcacgtaatggtggggactctagacagactgcctgcgcaagcagtgaggaaggcggggacgacgtcaggtcatcatggcccttacgcctagggctacacacgtgctacaatgggcggtacagcgggttgctactgggtgaccagatgccaatctcaaaaaaccgttctcagttcggatcggagtctgcaactcgactccgtgaagctggaatcactagtaatcgcgtatcagcaatgacgcggtgaatacgttcccgggccttgtacacaccgcccgtcaagccatggaagtttggtagacctgaagctggtgctccgcaacgaagccagttagggtagaacaagtaactagggctaagtcgtaacaaggtagccgtaccggaaggtgcggctggatcacctcctttct

SEQ ID NO: 4330 - DNA, 885 bp, Hymenobacter sp. 1-3-3-3
  ref <308>: DATABASE ACCESSION NUMBER: NCBI ACCESSION: NZ_SEWE01000003.1
  ref <309>: DATABASE ENTRY DATE: 2019-04-01
  ref <313>: RELEVANT RESIDUES IN SEQ ID NO: (1)..(885)
tacaatggagagtttgatcctggctcaggatgaacgctagcggcaggcctaatacatgcaagtcgaacggatgtagcaatacattagtggcgcacgggtgcgtaacgcgtaaccaacctacctggatctgggggatagcccgccgaaaggcggattaataccgcataacactgcagagcggcatcgctgaacagttaaagatttattggattcagatggggttgcgtgacattagctagttggcggggtaacggcccaccaaggcgacgatgtctaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaaggtgatgcgtcacaaactgacggtacctgaggaataagcaccggctaactccgtgccagcagccgcggtaatacggagggtgcaagcgttgtccggatttattgggtttaaagggtgcgtaggtggccctataagtccgtggtgaaagcctgctgctcaacagcagaactgccatggatactgtagggcttgagtccagacgaggttggcggaatggaagatgtagcggtgaaatgcatagatatcttccagaaccccgattgcgtaggcagctgactaggctggtactgacactgaggcacgaaagcgtggggagcgaacaggattagataccctggtagtccacgccgtaaacgatggatactcgttgctagcgatacacagttagtgacttagcgaaagcgttaagtatcccacctggggagtacgctcgcaagagtg

SEQ ID NO: 4331 - DNA, 1511 bp, Hymenobacter sp. 9PBR-2
  ref <308>: DATABASE ACCESSION NUMBER: NCBI ACCESSION: NZ_RWIS01000027.1
  ref <309>: DATABASE ENTRY DATE: 2019-04-01
  ref <313>: RELEVANT RESIDUES IN SEQ ID NO: (1)..(1511)
tggagagtttgatcctggctcaggatgaacgctagcggcaggcctaatacatgcaagtcgaacgggtgtagcaatacactagtggcgcacgggtgcgtaacgcgtaaccaacctgcccttgactgggggatagcccgccgaaaggcggattaataccgcataacctcgcagtgtggcatcacataacgagtaaagatttattggtcaaggatggggttgcgtagcattagctagatggcggggtaacggcccaccatggcgacgatgcttaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaacgggtgtgcgcactcaactgacggtacctgaggaataagcaccggctaactccgtgccagcagccgcggtaatacggagggtgcaagcgttgtccggatttattgggtttaaagggtgcgtaggcggcccgttaagtccggggtgaaagcccacagctcaactgtggaactgccctggatactggcgggcttgagtccagacgaggttggcggaatggatgctgtagcggtgaaatgcatagatagcatccagaaccccgattgcgaaggcagctgactaggctggtactgacgctgaggcacgaaagcgtggggagcgaacaggattagataccctggtagtccacgccgtaaacgatggatactcgctggtggcaatagaccgtcactggcttagcgaaagcggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggctcagagatgagcttttccttcgggacacaaagcaaggtgctgcatggccgtcgtcagctcgtgccgtgaggtgttgggttaagtcccgcaacgagcgcaacccctacatttagttgccatcaggttaagctggggactctagatggactgcctgcgcaagcagtgaggaaggcggggacgacgtcaggtcatcatggcccttacgcctagggctacacacgtgctacaatggacggtacagagggtcgctacacagtgatgtgatgccaatctcacaaagccgttctcagttcggattgaagtctgcaactcgacttcatgaagctggaatcactagtaatcgcgtatcagcaatgacgcggtgaatacgttcccgggccttgtacacaccgcccgtcaagccatggaagtctggtagacctgaagctggtgctccgcaacgaagccagttagggtagaacaggtaactggggctaagtcgtaacaaggtagccgtaccggaaggtgcggctggatcacctcctttct

SEQ ID NO: 4332 - DNA, 1512 bp, Hymenobacter sp. APR13
  ref <308>: DATABASE ACCESSION NUMBER: NCBI ACCESSION: NZ_CP006587.1
  ref <309>: DATABASE ENTRY DATE: 2019-04-01
  ref <313>: RELEVANT RESIDUES IN SEQ ID NO: (1)..(1512)
tggagagtttgatcctggctcaggatgaacgctagcggcaggcctaatacatgcaagtcgaacgggtatagcaatatactagtggcgcacgggtgcgtaacgcgtaaccaacctgccctgaactgggggatagcccgccgaaaggcggattaataccgcataacacttctcactggcatcagtggttagttaaagatttattggttcaggatggggttgcgtgacattagctagttggcggggtaacggcccaccaaggcgacgatgtctaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaaggtgatgcgtcacaaactgacggtacctgaggaataagcaccggctaactccgtgccagcagccgcggtaatacggagggtgcaagcgttgtccggatttattgggtttaaagggtgcgtaggtggcccgttaagtccggggtgaaagcccacagctcaactgtggaactgccctggatactggcgggcttgagtccagacgaggttggcggaatggaagatgtagcggtgaaatgcatagatatcttccagaaccccgattgcgtaggcagctgactaggctggtactgacactgaggcacgaaagcgtggggagcgaacaggattagataccctggtagtccacgccgtaaacgatggatactcgctggtggcgatagacagtcactggcttagcgaaagcggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggttcagagatggacctttccttcgggacacaaagcaaggtgctgcatggccgtcgtcagctcgtgccgtgaggtgttgggttaagtcccgcaacgagcgcaacccctacatttagttgccatcaggttaagctggggactctagatggactgcctgcgcaagcagtgaggaaggcggggacgacgtcaggtcatcatggcccttacgcctagggctacacacgtgctacaatggacggtacagagggtcgctacctggtgacaggatgccaatctcacaaaagccgttctcagttcggatcgaagtctgcaactcgacttcgtgaagctggaatcactagtaatcgcgtatcagcaatgacgcggtgaatacgttcccgggccttgtacacaccgcccgtcaagccatggaagtctggtagacctgaagctggtgctccgcaacgaagccagttagggtagaacaggtaactggggctaagtcgtaacaaggtagccgtaccggaaggtgcggctggatcacctcctttct

SEQ ID NO: 4333 - DNA, 1513 bp, Hymenobacter sp. CCM 8763
  ref <308>: DATABASE ACCESSION NUMBER: NCBI ACCESSION: NZ_QVLT01000066.1
  ref <309>: DATABASE ENTRY DATE: 2019-04-01
  ref <313>: RELEVANT RESIDUES IN SEQ ID NO: (1)..(1513)
tggagagtttgatcctggctcaggatgaacgctagcggcaggcctaatacatgcaagtcgaacgggtggtagcaataccactagtggcgcacgggtgcgtaacgcgtaaccaatctgccctgaactgggggatagcccgccgaaaggcggattaataccgcataaacccacagtgtggcatcacataatgggtaaagatttattggttcaggatgaggttgcgtgccattagctagttggcggggtaaaggcccaccaaggcgacgatggctaggggacctgagagggtgatcccccacactggcactgagatacgggccagactcctacgggaggcagcagtagggaatattgggcaatggacgagagtctgacccagccatgccgcgtgccggatgaaggccttctgggttgtaaacggcttttctcagggaagaaaaagaccatgcgtggtacactgacggtacctgaggaataagcaccggctaactccgtgccagcagccgcggtaatacggagggtgcaagcgttgtccggatttattgggtttaaagggtgcgtaggcggcccgttaagtccggggtgaaatcccacagctcaactgtggaactgccctggatactggcgggcttgagtccagacgaggttggcggaatggaaggtgtagcggtgaaatgcatagataccttccagaaccccgattgcgtaggcagctgactaggctggtactgacgctgaggcacgaaagcgtggggagcgaacaggattagataccctggtagtccacgccgtaaacgatggatactcgctggtagcgatatactgttactggcttagcgaaagcggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggttcagagatgagcctttccttcgggacacaaagcaaggtgctgcatggccgtcgtcagctcgtgccgtgaggtgttgggttaagtcccgcaacgagcgcaacccctatgtttagttgccagcatgttatgatggggactctaaacagactgcctgcgcaagcagtgaggaaggcggggacgacgtcaggtcatcatggcccttacgcctagggctacacacgtgctacaatgggcggtacagcgggttgctactaggtgactagatgccaatctcaaaaaaccgttctcagttcggatcggagtctgcaactcgactccgtgaagctggaatcactagtaatcgcgtatcagcaatgacgcggtgaatacgttcccgggccttgtacacaccgcccgtcaagccatggaagtttggtagacctgaagctggtgctcgtcacagaagccagttagggtagaacaagtaactagggctaagtcgtaacaaggtagccgtaccggaaggtgcggctggatcacctcctttct

SEQ ID NO: 4334 - DNA, 1518 bp, Hymenobacter sp. CRA2
  ref <308>: DATABASE ACCESSION NUMBER: NCBI ACCESSION: NZ_MVBC01000034.1
  ref <309>: DATABASE ENTRY DATE: 2019-04-01
  ref <313>: RELEVANT RESIDUES IN SEQ ID NO: (1)..(1518)
ttacaatggagagtttgatcctggctcaggatgaacgctagcggcaggcctaatacatgcaagtcgaacgggcggtagcaataccgctagtggcgcacgggtgcgtaacgcgtaggcaatctgcctactcctgggggatagcccgccgaaaggtggattaataccgcataagactacagagcggcatcgtttagtagttaaagaatttcgggagtagatgagcctgcgtgccattagctagttggcggggtaagggcccaccaaggcgacgatggctaggggagctgagaggccgatcccccacactggcactgagatacgggccagactcctacgggaggcagcagtagggaatattgggcaatggaggagactctgacccagccatgccgcgtgacggatgaaggccttctgggttgtaaacgtcttttgcccgggaagaaaaaactcttgcgagaggaatcgacggtaccgggtgaataagcaccggctaactccgtgccagcagccgcggtaatacggagggtgcaagcgttgtccggatttattgggtttaaagggtgcgtaggtggccctgcaagtccgtggtgaaagcctgctgctcaacagcagaactgccatggatactacagggcttgagtccagacgaggttggcggaatggatggtgtagcggtgaaatgcatagataccatccagaaccccgattgcgtaggcagctgactaggctggtactgacactgaggcacgaaagcgtggggagcgaacaggattagataccctggtagtccacgccgtaaacgatggatactcgctgtgggcgatacacagtccgcggcttagcgaaagcgttaagtatcccacctggggagtacgccggcaacggtgaaactcaaaggaattgacgggggcccgcacaagtggtggagcatgtggtttaattcgatgatacgcgaggaaccttaccgaggctagaatgcgcgtgaccggttcagagatggacctttccttcgggacacaaagcaaggtgctgcatggccgtcgtcagctcgtgccgtgaggtgttgggttaagtcccgcaacgagcgcaacccctatgtttagttgccagcggattatgccggggactctagacagactgcctgcgcaagcagcgaggaaggcggggacgacgtcaggtcatcatggcccttacgcctcgggctacacacgtgctacaatggacggtacagagggtcgccacctggcaacagggagccaatctcaaaaagccgttctcagttcggatcggagtctgcaactcgactccgtgaagctggaatcactagtaatcgcgtatcagcaacgacgcggtgaatacgttcccgggccttgtacacaccgcccgtcaagccatggaagtctggtggacctgaagctggtgctcgtcacagaagccagttagggtaaaacaggtaactggggctaagtcgtaacaaggtagccgtaccggaaggtgcggctggatcacctcctttct

SEQ ID NO: 4335 - DNA, 1519 bp, Hymenobacter sp. DG25A
  ref <308>: DATABASE ACCESSION NUMBER: NCBI ACCESSION: NZ_CP012623.1
  ref <309>: DATABASE ENTRY DATE: 2019-04-01
  ref <313>: RELEVANT RESIDUES IN SEQ ID NO: (1)..(1519)
ttacaatggagagtttgatcctggctcaggatgaacgctagcggcaggcctaatacatgcaagtcgaacgggtggtagcaataccactagtggcgcacgggtgcgtaacgcgtaaccaacctgcccttgactgggggatagcccgccgaaaggcggattaataccgcataaaccaacagcctggcatcaggcaattggtaaagatttattggtcaaggatggggttgcgtgacattagcttgttggcggggtaacggcccaccaaggcgacgatgtctaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaagaccatgcgtggtacactgacggtacctgaggaataagcaccggctaactccgtgccagcagccgcggtaatacggagggtgcaagcgttgtccggatttattgggtttaaagggtgcgtaggtggccttgtaagtccgtggtgaaagcctctcgcttaacgagagaactgccatggatactgcaaggcttgagtccagacgaggttggcggaatggatggtgtagcggtgaaatgcatagataccatccagaaccccgattgcgtaggcagctgactaggctggtactgacactgaggcacgaaagcgtggggagcgaacaggattagataccctggtagtccacgccgtaaacgatggatactcgttgctagcgatatacagttagtgacttagcgaaagcgttaagtatcccacctggggagtacgcccgcaagggtgaaactcaaaggaattgacgggggcccgcacaagtggtggagcatgtggtttaattcgatgatacgcgaggaaccttacctaggctagaatgcgcgtgaccggttcagagatgaacctttccttcgggacacaaagcaaggtgctgcatggccgtcgtcagctcgtgccgtgaggtgttgggttaagtcccgcaacgagcgcaacccctacatttagttgccagcggattatgccggggactctagatggactgcctgcgcaagcagtgaggaaggcggggacgacgtcaggtcatcatggcccttacgcctagggctacacacgtgctacaatggacggtacagagggtcgctacacagtgatgtgacgccaatctcaaaaaaccgttctcagttcggatcgaagtctgcaactcgacttcgtgaagctggaatcactagtaatcgcgtatcagcaatgacgcggtgaatacgttcccgggccttgtacacaccgcccgtcaagccatggaagtctggtagacctgaagctggtgctcgtaatagaagccagttagggtagaacaggtaactggggctaagtcgtaacaaggtagccgtaccggaaggtgcggctggatcacctcctttct

SEQ ID NO: 4336 - DNA, 1517 bp, Hymenobacter sp. DG25B
  ref <308>: DATABASE ACCESSION NUMBER: NCBI ACCESSION: NZ_CP010054.1
  ref <309>: DATABASE ENTRY DATE: 2019-04-01
  ref <313>: RELEVANT RESIDUES IN SEQ ID NO: (1)..(1517)
ttacaatggagagtttgatcctggctcaggatgaacgctagcggcaggcctaatacatgcaagtcgaacgggtgtagcaatacactagtggcgcacgggtgcgtaacgcgtaaccaacctgcccttgactgggggatagcccgccgaaaggcggattaataccgcataaaccaacagcctggcatcaggcaattggtaaagatttattggtcaaggatggggttgcgtgacattagctagttggcggggtaacggcccaccaaggcgacgatgtctaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaagaccatgcgtggtacactgacggtacctgaggaataagcaccggctaactccgtgccagcagccgcggtaatacggagggtgcaagcgttgtccggatttattgggtttaaagggtgcgtaggtggccttgtaagtccgtggtgaaagcctctcgcttaacgagagaactgccatggatactgcaaggcttgagtccagacgaggttggcggaatggatggtgtagcggtgaaatgcatagataccatccagaaccccgattgcgtaggcagctgactaggctggtactgacactgaggcacgaaagcgtggggagcgaacaggattagataccctggtagtccacgccgtaaacgatggatactcgttgctagcgatatacagttagtgacttagcgaaagcgttaagtatcccacctggggagtacgcccgcaagggtgaaactcaaaggaattgacgggggcccgcacaagtggtggagcatgtggtttaattcgatgatacgcgaggaaccttacctaggctagaatgcgcgtgaccggttcagagatgaacctttccttcgggacacaaagcaaggtgctgcatggccgtcgtcagctcgtgccgtgaggtgttgggttaagtcccgcaacgagcgcaacccctacatttagttgccagcggattatgccggggactctagatggactgcctgcgcaagcagtgaggaaggcggggacgacgtcaggtcatcatggcccttacgcctagggctacacacgtgctacaatggacggtacagagggtcgctacacagtgatgtgacgccaatctcaaaaaaccgttctcagttcggatcgaagtctgcaactcgacttcgtgaagctggaatcactagtaatcgcgtatcagcaatgacgcggtgaatacgttcccgggccttgtacacaccgcccgtcaagccatggaagtctggtagacctgaagctggtgctcgtcacagaagccagttagggtagaacaggtaactggggctaagtcgtaacaaggtagccgtaccggaaggtgcggctggatcacctcctttct

SEQ ID NO: 4337 - DNA, 1516 bp, Hymenobacter sp. ELS1360
  ref <308>: DATABASE ACCESSION NUMBER: NCBI ACCESSION: NZ_QKNS01000020.1
  ref <309>: DATABASE ENTRY DATE: 2019-04-01
  ref <313>: RELEVANT RESIDUES IN SEQ ID NO: (1)..(1516)
tacaatggagagtttgatcctggctcaggatgaacgctagcggcaggcctaatacatgcaagtcgaacggtggtagcaataccatagtggcgcacgggtgcgtaacgcgtaaccaacctgccccgatctgggggatagcccgccgaaaggcggattaataccgcataacccaacaaggtggcatcacctaattggtaaagatttattggatcgggatggggttgcgtgacattagctagttggcggggtaacggcccaccaaggcgacgatgtctaggggacctgagagggtgatcccccacactggcactgagatacgggccagactcctacgggaggcagcagtagggaatattgggcaatggacgagagtctgacccagccatgccgcgtgccggatgaaggccttctgggttgtaaacggcttttctcagggaagaaaaaggggatgcgtcctcaactgacggtacctgaggaataagcaccggctaactccgtgccagcagccgcggtaatacggagggtgcaagcgttgtccggatttattgggtttaaagggtgcgtaggcggcttgttaagtccggggtgaaagcccactgctcaacagtggaactgccctggatactggcaagcttgagtccagacgaggttggcggaatggatggtgtagcggtgaaatgcatagataccatccagaaccccgattgcgaaggcagctgactaggctggtactgacgctgaggcacgaaagcgtggggagcgaacaggattagataccctggtagtccacgccgtaaacgatggatactcgctggtggcgatagatagtcactggcttagcgaaagcggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggctcagagatgagcctttccttcgggacacaaagcaaggtgctgcatggccgtcgtcagctcgtgccgtgaggtgttgggttaagtcccgcaacgagcgcaacccctacatttagttgccatcaggttaagctggggactctagatggactgcctgcgcaagcagtgaggaaggcggggacgacgtcaggtcatcatggcccttacgcctagggctacacacgtgctacaatgggcggtacagagggtcgctactaggtgactagatgccaatctcaaaaaaccgttctcagttcggattgaagtctgcaactcgacttcatgaagctggaatcactagtaatcgcgtatcagccatgacgcggtgaatacgttcccgggccttgtacacaccgcccgtcaagccatggaagtttggtagacctgaagctggtgctcgtcacagaagccagttagggtagaacaagtaactggggctaagtcgtaacaaggtagccgtaccggaaggtgcggctggatcacctcctttct

SEQ ID NO: 4338 - DNA, 1521 bp, Hymenobacter sp. IS2118
  ref <308>: DATABASE ACCESSION NUMBER: NCBI ACCESSION: NZ_JNLX01000069.1
  ref <309>: DATABASE ENTRY DATE: 2019-04-01
  ref <313>: RELEVANT RESIDUES IN SEQ ID NO: (1)..(1521)
ttacaatggagagtttgatcttggctcaggatgaacgctagcggcaggcctaatacatgcaagtcgaacggtctttagcaatagagatagtggcgcacgggtgcgtaacgcgtaaccaacctacctgaatctgggggatagcccgccgaaaggcggattaataccgcataaaaccacagagtggcatcacttaatggttaaagatttattggattcagatggggttgcgtgccattagctagttggggaggtaacggctcaccaaggcgacgatggctaggggagctgagaggctggtcccccacacgggcactgagatacgggcccgactcctacgggaggcagcagtagggaatattgggcaatggacgagagtctgacccagccatgccgcgtgcaggatgaaggctttctgagtcgtaaactgcttttctcagggaagaaaaaagggcatgcgtgctctactgacggtacctgaggaataagcaccggctaactccgtgccagcagccgcggtaatacggagggtgcaagcgttgtccggatttattgggtttaaagggtgcgtaggcggttctttaagtccggggtgaaagcccactgctcaacagtggaactgccctggaaactggcgaacttgagtacagacgagggtggcggaatggatactgtagcggtgaaatgcatagatagtatccagaacaccgattgcgaaggcagctgcctagactgtaactgacgctgaggcacgaaagcgtggggagcgaacaggattagataccctggtagtccacgccgtaaacgatggatactcgctggtggcgatagatggtcactggcttagcgaaagcgttaagtatcccacctggggagtacgctcgcaagagtgaaactcaaaagaattgacgggggcccgcacaagtggtggagcatgtggtttaattcgatgatacgcgaggaaccttacctaggctagaatgcgcgtgaccggctcagagatgagcctttccttcgggacacaaagcaaggtgctgcatggccgtcgtcagctcgtgccgtgaggtgttgggttaagtcccgcaacgagcgcaacccctatgtttagttgccagcatgtaatgatggggactctagacagactgcctgcgcaagcagtgaggaaggcggggacgacgtcaggtcatcatggcccttacgcctagggctacacacgtgctacaatggacggtacagcgggttgccaaccagcgatggtgcgccaatcccgaaaagccgttctcagttcggatcggagtctgcaactcgactccgtgaagctggaatcactagtaatcgcgtatcagcaatgacgcggtgaatacgttcccgggccttgtacacaccgcccgtcaagccatggaagtttggtagacctgaagctggtgctccgcaacgaagccagttagggtagaacaggtaactagggctaagtcgtaacaaggtagccgtaccggaaggtgcggctggatcacctcctttctg

SEQ ID NO: 4339 - DNA, 1517 bp, Hymenobacter sp. MIMBbqt21
  ref <308>: DATABASE ACCESSION NUMBER: NCBI ACCESSION: NZ_MTSE01000006.1
  ref <309>: DATABASE ENTRY DATE: 2019-04-01
  ref <313>: RELEVANT RESIDUES IN SEQ ID NO: (1)..(1517)
tacaatggagagtttgatcctggctcaggatgaacgctagcggcaggcctaatacatgcaagtcgaacggtggtagcaataccatagtggcgcacgggtgcgtaacgcgtaaccaacctacccaaaactgggggatagcccgccgaaaggcggattaataccgcataagaccatggcctggcatcaggcagtggttaaagatttattggttttggatggggttgcgtagcattagctagttggcggggtaacggcccaccaaggcgacgatgcttaggggacctgagagggtgatcccccacactggcactgagatacgggccagactcctacgggaggcagcagtagggaatattgggcaatggtcgagagactgacccagccatgccgcgtgccggatgaaggccttctgggttgtaaacggcttttctcagggaagaaaaaacgggatgcgtcccgctctgacggtacctgaggaataagcaccggctaactccgtgccagcagccgcggtaatacggagggtgcaagcgttgtccggatttattgggtttaaagggtgcgtaggtggcctggtaagtccgtggtgaaagcctcctgctcaacaggagaactgccatggatactgccgggcttgagtccagacgaggttggcggaatagaggctgtagcggtgaaatgcatagatagcctctagaaccccgattgcgtaggcagctgactaggctggtactgacactgaggcacgaaagcgtggggagcgaacaggattagataccctggtagtccacgccgtaaacgatggatactcgctggcagcgatacactgttgctggctgagcgaaagcgttaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccgcctcagagatgaggctttccttcgggacacaaagcaaggtgctgcatggccgtcgtcagctcgtgccgtgaggtgttgggttaagtcccgcaacgagcgcaacccctatgtttagttgccatcaggttatgctggggactctagacagactgcctgcgcaagcagtgaggaaggcggggacgacgtcaggtcatcatggcccttacgcctagggctacacacgtgctacaatggccggtacagagggtcgctacacagtgatgtgatgccaatctcaaaaaaccggtctcagttcggatcggagtctgcaactcgactccgtgaagctggaatcactagtaatcgcgtatcagcaatgacgcggtgaatacgttcccgggccttgtacacaccgcccgtcaagccatggaagtttggtagacctgaagccggtgctcgtcacagaagccggttagggtagaacaagtaactggggctaagtcgtaacaaggtagccgtaccggaaggtgcggctggatcacctcctttct

SEQ ID NO: 4340 - DNA, 1516 bp, Hymenobacter sp. NL
  ref <308>: DATABASE ACCESSION NUMBER: NCBI ACCESSION: NZ_QHKM01000023.1
  ref <309>: DATABASE ENTRY DATE: 2019-04-01
  ref <313>: RELEVANT RESIDUES IN SEQ ID NO: (1)..(1516)
ttacaatggagagtttgatcctggctcaggatgaacgctagcggcaggcctaatacatgcaagtcgaacggtggtagcaataccatagtggcgcacgggtgcgtaacgcgtaggcaatctgcctactcctgggggatagcccgccgaaaggtggattaataccgcataagactatagggcggcatcgtctagtagttaaagaatttcgggagtagatgagcctgcgtgccattagctagttggtgcggtaacggcgcaccaaggcgacgatggctaggggagctgagaggccgatcccccacactggcactgagatacgggccagactcctacgggaggcagcagtagggaatattgggcaatgggcgcgagcctgacccagccatgccgcgtgacggatgaaggccttctgggttgtaaacgtcttttgaccgggaagaaaaagcccttgcgagggaaatcgacggtaccggttgaataagcaccggctaactccgtgccagcagccgcggtaatacggagggtgcaagcgttgtccggatttattgggtttaaagggtgcgtaggtggccctgcaagtccgtggtgaaagcctgccgcttaacggcagaactgccatggatactacagggcttgagtccagacgaggttggcggaatggatggtgtagcggtgaaatgcatagataccatccagaaccccgattgcgtaggcagctgactaggctggtactgacactgaggcacgaaagcgtggggagcgaacaggattagataccctggtagtccacgccgtaaacgatggatactcgctgtgggcgatacacagtccgcggcttagcgaaagcgttaagtatcccacctggggagtacgccggcaacggtgaaactcaaaggaattgacgggggcccgcacaagtggtggagcatgtggtttaattcgatgatacgcgaggaaccttaccgaggctagaatgcgcgtgaccggttcagagatggacctttccttcgggacacaaagcaaggtgctgcatggccgtcgtcagctcgtgccgtgaggtgttgggttaagtcccgcaacgagcgcaacccctatgtttagttgccagcacgtaatggtggggactctagacagactgcctgtgcaaacagcgaggaaggcggggacgacgtcaggtcatcatggcccttacgcctcgggctacacacgtgctacaatggacggtacagagggtcgccacgcagcgatgcggagccaatctcaaaaagccgttctcagttcggatcggagtctgcaactcgactccgtgaagctggaatcactagtaatcgcgtatcagcaacgacgcggtgaatacgttcccgggccttgtacacaccgcccgtcaagccatggaagtctggtagacctgaagctggtgccccgcaacggagccagttagggtagaacaggtaactggggctaagtcgtaacaaggtagccgtaccggaaggtgcggctggatcacctcctttct

SEQ ID NO: 4341 - DNA, 1521 bp, Hymenobacter sp. PAMC 26554
  ref <308>: DATABASE ACCESSION NUMBER: NCBI ACCESSION: NZ_CP014771.1
  ref <309>: DATABASE ENTRY DATE: 2019-04-01
  ref <313>: RELEVANT RESIDUES IN SEQ ID NO: (1)..(1521)
ttacaatggagagtttgatcctggctcaggatgaacgctagcggcaggcctaatacatgcaagtcgaacggtggcagcaatgtcatagtggcgcacgggtgcgtaacacgtaactaacctacctatacctgggggatagcccgccgaaaggcggattaataccgcataagctattaacctggcatcaggtgattagtaaagatttattgggtatagatggggttgcgggtcattagctagttgggtgggtaacggctgcccaaggcgacgatgactaggggagctgagaggctggtcccccacacgggcactgagatacgggcccgactcctacgggaggcagcagtagggaatattgggcaatgggcgagagcctgacccagccatgccgcgtgcaggaagaaggctttctgagtcgtaaactgcttttgacagggaagaataagcttcacgtgtggagtgatgacggtacctgcagaataagcaccggctaactccgtgccagcagccgcggtaatacggagggtgcgagcgttgtccggatttattgggtttaaagggtgcgtaggcggtcgattaagtctggggtgaaagcccgctgctcaacagcggaactgccctggatactggttgacttgagtacagacgaggttggcggaatggacggagtagcggtgaaatgcatagataccgtccagaaccccgattgcgaaggcagctgactaggctgatactgacgctgaggcacgaaagcgtggggagcgaacaggattagataccctggtagtccacgccgtaaacgatggatactcgctgcgagctaaagattgttcgtggcttagggaaaccgataagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggttcagagatggacttttccttcgggacacaaagcaaggtgctgcatggccgtcgtcagctcgtgccgtgaggtgttgggttaagtcccgcaacgagcgcaacccctatagttagttgccagcacgtaatggtggggactctagctagactgcctgcgcaagcagtgaggaaggcggggacgacgtcaggtcatcatggcccttacgcctagggcgacacacgtgctacaatggacggtacagcgggtagctactgggcgaccagatgccaatctcgaaaagccgttctcagttcggatcggagtctgcaactcgactccgtgaagctggaatcactagtaatcgcgcatcagccatggcgcggtgaatacgttcccgggccttgtacacaccgcccgtcaagccatggaagtttggtagacctgaagctggtgctccgcaacgaagccagttagggtagaacaggtaactagggctaagtcgtaacaaggtagccgtaccggaaggtgcggctggatcacctcctttctgga

SEQ ID NO: 4342 - DNA, 1516 bp, Hymenobacter sp. PAMC 26628
  ref <308>: DATABASE ACCESSION NUMBER: NCBI ACCESSION: NZ_CP014304.1
  ref <309>: DATABASE ENTRY DATE: 2019-04-01
  ref <313>: RELEVANT RESIDUES IN SEQ ID NO: (1)..(1516)
acaatggagagtttgatcctggctcaggatgaacgctagcggcaggcctaatacatgcaagtcgaacggtggcagcaatgccatagtggcgcacgggtgcgtaacgcgtagccaacctacccgaatctgggggatagcccgccgaaaggcggattaataccgcataagactttggtccggcatcgggcagaagttaaagatttattggattcggatggggctgcgtgccattagctagttgggggggtaacggcccaccaaggcgacgatggctaggggagctgagaggctggtcccccacacgggcactgagatacgggcccgactcctacgggaggcagcagtagggaatattgggcaatggaggagactctgacccagccatgccgcgtgccggatgaaggccttctgggtcgtaaacggcttttttccgggaagaaccggtcctgtgcgcagggccctgacggtaccgggagaataagcaccggctaactccgtgccagcagccgcggtaatacggagggtgcgagcgttgtccggatttattgggtttaaagggtgcgtaggcggccgcgtaagtctggggtgaaagcccgttgctcaacaacggaactgccctggaaactgcgcggcttgagtccagacgaggttggcggaatgggcggtgtagcggtgaaatgcatagataccgtccagaaccccgattgcgaaggcagctgactaggctggtactgacgctgaggcacgaaagcgtggggagcgaacaggattagataccctggtagtccacgccgtaaacgatggatactcgctggtggcgatagacggtcactggcttagcgaaagcgttaagtatcccacctggggagtacgcccgcaagggtgaaactcaaaggaattgacgggggcccgcacaagtggtggagcatgtggtttaattcgatgatacgcgaggaaccttacctaggctagaatgcgcgtgaccggttcggagacgaacctttccttcgggacacaaagcaaggtgctgcatggccgtcgtcagctcgtgccgtgaggtgttgggttaagtcccgcaacgagcgcaacccctacatttagttgccagcgggtcgtgccggggactctagatggactgcctgcgcaagcagtgaggaaggcggggacgacgtcaggtcatcatggcccttacgcctagggctacacacgtgctacaatggacggtacagcgggttgccaaccagcgatggtgcgccaatcccgaaaagccgttctcagttcggatcggagtctgcaactcgactccgtgaagctggaatcactagtaatcgcgcatcagcaatggcgcggtgaatacgttcccgggccttgtacacaccgcccgtcaagccatggaagtttggtagacctgaagccggtgctccgcaacgaagccggttagggtagaacaggtaactagggctaagtcgtaacaaggtagccgtaccggaaggtgcggctggatcacctcctttct

SEQ ID NO: 4343 - DNA, 1511 bp, Hymenobacter sp. YR204
  ref <308>: DATABASE ACCESSION NUMBER: NCBI ACCESSION: NZ_RBXM01000008.1
  ref <309>: DATABASE ENTRY DATE: 2019-04-01
  ref <313>: RELEVANT RESIDUES IN SEQ ID NO: (1)..(1511)
tggagagtttgatcctggctcaggatgaacgctagcggcaggcctaatacatgcaagtcgaacggtggtagcaataccatagtggcgcacgggtgcgtaacgcgtaaccaacctgcccttgactgggggatagcccgccgaaaggcggattaataccgcataaaccaacagcctggcatcaggcaattggtaaagatttattggtcaaggatggggttgcgtgacattagctagttggcggggtaacggcccaccaaggcgacgatgtctaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaagaccatgcgtggtacactgacggtacctgaggaataagcaccggctaactccgtgccagcagccgcggtaatacggagggtgcaagcgttgtccggatttattgggtttaaagggtgcgtaggtggccttgtaagtccgtggtgaaagcctctcgcttaacgagagaactgccatggatactgcaaggcttgagtccagacgaggttggcggaatggatggtgtagcggtgaaatgcatagataccatccagaaccccgattgcgtaggcagctgactaggctggtactgacactgaggcacgaaagcgtggggagcgaacaggattagataccctggtagtccacgccgtaaacgatggatactcgttgctagcgatatacagttagtgacttagcgaaagcgttaagtatcccacctggggagtacgcccgcaagggtgaaactcaaaggaattgacgggggcccgcacaagtggtggagcatgtggtttaattcgatgatacgcgaggaaccttacctaggctagaatgcgcgtgaccggctcagagatgagcctttccttcgggacacaaagcaaggtgctgcatggccgtcgtcagctcgtgccgtgaggtgttgggttaagtcccgcaacgagcgcaacccctacatttagttgccagcggattatgccggggactctagatggactgcctgcgcaagcagtgaggaaggcggggacgacgtcaggtcatcatggcccttacgcctagggctacacacgtgctacaatggacggtacagagggtcgctacacagtgatgtgacgccaatctcaaaaaaccgttctcagttcggatcgaagtctgcaactcgacttcgtgaagctggaatcactagtaatcgcgtatcagcaatgacgcggtgaatacgttcccgggccttgtacacaccgcccgtcaagccatggaagtctggtagacctgaagctggtgctcgttaaagaagccagttagggtagaacaggtaactggggctaagtcgtaacaaggtagccgtaccggaaggtgcggctggatcacctcctttct

SEQ ID NO: 4344 - DNA, 1505 bp, Hymenobacter sp. sh-6
  ref <308>: DATABASE ACCESSION NUMBER: NCBI ACCESSION: NZ_CP032317.1
  ref <309>: DATABASE ENTRY DATE: 2019-04-01
  ref <313>: RELEVANT RESIDUES IN SEQ ID NO: (1)..(1505)
agagtttgatcctggctcaggatgaacgctagcggcaggcctaatacatgcaagtcgaacggggcagcaatgcccagtggcgcacgggtgcgtaacgcgtaggcaatctgcctacacctgggggatagcccgccgaaaggtggattaataccgcataacactgcgaggcggcatcgtctggtagttaaagaatttcgggtgtagatgagcctgcgtgccattagctagttggcggggtaagggcccaccaaggcgacgatggctaggggagctgagaggccgatcccccacactggcactgagatacgggccagactcctacgggaggcagcagtagggaatattgggcaatggcggaaacgctgacccagccatgccgcgtgccggatgacggccttctgggttgtaaacggcttttgcccgggaagaaaagaccgctgcggcgggaatcgacggtaccgggtgaataagcaccggctaactccgtgccagcagccgcggtaatacggagggtgcgagcgttgtccggatttattgggtttaaagggtgcgtaggcggcccggtaagtccgtggtgaaagcccctcgctcaacgagggaactgccatggatactgccgggcttgagtccaggcgaggttggcggaatggatggtgtagcggtgaaatgcatagataccatccagaaccccgattgcgtaggcagctgactaggctggtactgacgctgaggcacgaaagcgtggggagcaaacaggattagataccctggtagtccacgccgtaaacgatggatactcgctgtgggcgatacatggtccgcggcttagcgaaagcgttaagtatcccacctggggagtacgccggcaacggtgaaactcaaaggaattgacgggggcccgcacaagtggtggagcatgtggtttaattcgatgatacgcgaggaaccttaccgaggctagaatgcgcgtgaccggtccggagacggacctttccttcgggacacaaagcaaggtgctgcatggccgtcgtcagctcgtgccgtgaggtgttgggttaagtcccgcaacgagcgcaacccctatgtttagttgccagcgcgtcaaggcggggactctagacagactgcctgcgcaagcagcgaggaaggcggggacgacgtcaggtcatcatggcccttacgcctcgggctacacacgtgctacaatgggcggtacaacgggttgccactgcgcgagcaggcgccaatctcgaaaagccgttctcagttcggatcgcagtctgcaactcgactgcgtgaagctggaatcactagtaatcgcgtatcagcaacgacgcggtgaatacgttcccgggccttgtacacaccgcccgtcaagccatggaagtctggtagacctgaagccggtgctcgtcacagaagccggttagggtagaacaggtaactggggctaagtcgtaacaaggtagccgtaccggaaggtgcggctggatcacctcctttct

SEQ ID NO: 4345 - DNA, 1511 bp, Hymenobacter swuensis
  ref <308>: DATABASE ACCESSION NUMBER: NCBI ACCESSION: NZ_CP007145.1
  ref <309>: DATABASE ENTRY DATE: 2019-04-01
  ref <313>: RELEVANT RESIDUES IN SEQ ID NO: (1)..(1511)
tggagagtttgatcctggctcaggatgaacgctagcggcaggcctaatacatgcaagtcgaacgggtgtagcaatacactagtggcgcacgggtgcgtaacgcgtaaccaacctgcccttgactgggggatagcccgccgaaaggcggattaataccgcataaaccaacagtgtggcatcacacaattggtaaagatttattggtcaaggatggggttgcgtgacattagctagttggcggggtaacggcccaccaaggcgacgatgtctaggggacctgagagggtgatcccccacactggcactgagatacgggccagactcctacgggaggcagcagtagggaatattgggcaatgggcgagagcctgacccagccatgccgcgtgccggatgaaggccttctgggttgtaaacggcttttctcagggaagaaaaagaggatgcgtcctaaactgacggtacctgaggaataagcaccggctaactccgtgccagcagccgcggtaatacggagggtgcaagcgttgtccggatttattgggtttaaagggtgcgtaggcggcccgttaagtccggggtgaaagcccacagctcaactgtggaactgccctggatactggcgggcttgagtccagacgaggttggcggaatggaaggtgtagcggtgaaatgcatagataccttccagaaccccgattgcgtaggcagctgactaggctggtactgacgctgaggcacgaaagcgtggggagcgaacaggattagataccctggtagtccacgccgtaaacgatggatactcgctggtggcgatagacagtcactggcttagcgaaagcggtaagtatcccacctggggagtacgctcgcaagagtgaaactcaaaggaattgacgggggcccgcacaagtggtggagcatgtggtttaattcgatgatacgcgaggaaccttacctaggctagaatgcgcgtgaccggttcagagatgaacttttccttcgggacacaaagcaaggtgctgcatggccgtcgtcagctcgtgccgtgaggtgttgggttaagtcccgcaacgagcgcaacccctacatttagttgccatcaggttaagctggggactctagatggactgcctgcgcaagcagtgaggaaggcggggacgacgtcaggtcatcatggcccttacgcctagggctacacacgtgctacaatggacggtacagagggtcgctacacagtgatgtgatgccaatctcacaaagccgttctcagttcggatcgaagtctgcaactcgacttcgtgaagctggaatcactagtaatcgcgtatcagcaatgacgcggtgaatacgttcccgggccttgtacacaccgcccgtcaagccatggaagtctggtagacctgaagctggtgctccgcaacgaagccagttagggtagaacaggtaactggggctaagtcgtaacaaggtagccgtaccggaaggtgcggctggatcacctcctttct

SEQ ID NO: 4346 - DNA, 1209 bp, Hymenobacter terrenus
  misc_feature (388)..(388): n is a, c, g, or t
  ref <308>: DATABASE ACCESSION NUMBER: NCBI ACCESSION: NZ_LATM01000105.1
  ref <309>: DATABASE ENTRY DATE: 2019-04-01
  ref <313>: RELEVANT RESIDUES IN SEQ ID NO: (1)..(1209)
acgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagngaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 4347 - DNA, 1519 bp, Hymenobacteraceae bacterium SYSU D60016
  ref <308>: DATABASE ACCESSION NUMBER: NCBI ACCESSION: NZ_QCZK02000001.1
  ref <309>: DATABASE ENTRY DATE: 2019-04-01
  ref <313>: RELEVANT RESIDUES IN SEQ ID NO: (1)..(1519)
tggagagtttgatcctggctcaggatgaacgctagcggcaggcctaatacatgcaagtcgaacgaattcaacttcttcggaggttgggttagtggcgcacgggtgcgtaacgcgtatgcaacctaccttctattgggggatagcccggagaaatccggattaataccgcataacattgtttgagggcatccgaagacaattaaagctttggcgatagaagatgggcatgcgtgccattagctagttggtagtgtaacggactaccaaggcgacgatggctaggggctctgagaggacggtcccccacactggtactgagacacggaccagactcctacgggaggcagcagtagggaatattgggcaatggccgagaggctgacccagccatgccgcgtgcaggaagaaggccttctgggttgtaaactgcttttgtatgggaagaaaatgcccttgcgagggaaactgacggtaccatacgaataagcaccggctaactccgtgccagcagccgcggtaatacggagggtgcaagcgttgtccggatttattgggtttaaagggtgcgtaggcggcccattaagtcagtggtgaaatcccatggctcaaccatggaactgccattgatactggtgggcttgagtaaagtcgaggcaggcggaactggtggtgtagcggtgaaatgcatagataccaccaagaaccccgattgcgaaggcagcttgctgggctttaactgacgctgaggcacgaaagcgtggggagcgaacaggattagataccctggtagtccacgccgtaaacgatgataactcgatgttggcgatatacagtcagcgtccaagcgaaagcgttaagttatccacctggggagtacgcccgcaagggtgaaactcaaaggaattgacgggggcccgcacaagcggtggagcatgtggtttaattcgatgatacgcgaggaaccttacctaggctagaatgcgcgtgacggtaccagaaatggtacttcccttcggggcacaaagcaaggtgctgcatggctgtcgtcagctcgtgccgtgaggtgttgggttaagtcccgcaacgagcgcaacccctatcttcagttgccagcacgtaatggtggggactctggagagactgccttcgcaagaagtgaggaaggtggggacgacgtcaagtcatcatggcccttacgcctagggctacacacgtgctacaatggccggtacagagggttgccaaccagcgatggtgcgccaatctcaaaaagccggtctcagttcggatcgaagtctgcaactcgacttcgtgaagccggaatcgctagtaatcgcgtatcagcaacgacgcggtgaatacgttcccgggccttgtacacaccgcccgtcaagccatggaagtcagggagacctgaagtcggtgaccgcaaggagccgcctagggtaaaactggtaactggggctaagtcgtaacaaggtagccgtaccggaaggtgcggctggatcacctcctttct

SEQ ID NO: 4348 - DNA, 1465 bp, Hyphobacterium indicum
  ref <308>: DATABASE ACCESSION NUMBER: NCBI ACCESSION: NZ_QBDX01000002.1
  ref <309>: DATABASE ENTRY DATE: 2019-04-01
  ref <313>: RELEVANT RESIDUES IN SEQ ID NO: (1)..(1465)
caacctgagagtttgattctggctcagaacgaacgctggcggcaggcttaacacatgcaagtcgaacgcactcttcggagtgagtggcagacgggtgagtaacgcgtgggaatgtgcctatcggtacggaatagctccgggaaactggaattaatgccgtatacgccccctgggggaaagatttatcgccgatagatcagcccgcgttagattagctagttggtagggtaaaggcctaccaaggctacgatctatagctggtctgagaggatgatcagccacactgggactgagacacggcccagactcctacgggaggcagcagtggggaatcttggacaatgggggaaaccctgatccagccatgccgcgtgaatgatgaaggccttagggttgtaaaattctttcagcagggaagataatgacggtacctgcagaagaagccccggctaactccgtgccagcagccgcggtaatacggagggggctagcgttgttcggaattactgggcgtaaagcgcacgtaggcggattgttaagttagaggtgaaagcccggagctcaactccggaatagcctttgatactggcagtctagagttcaggagaggtgagcggaattccgagtgtagaggtgaaattcgtagatattcggaggaacaccagaggcgaaggcggctcactggactgatactgacgctgaggtgcgaaagcgtggggagcaaacaggattagataccctggtagtccacgccgtaaacgatgagagctagttgtcaggcagcatgctgtttggtgacgcagctaacgcattaagctctccgcctggggagtacggccgcaaggttaaaactcaaagaaattgacgggggcccgcacaagcggtggagcatgtggtttaattcgaagcaacgcgcagaaccttacctacccttgacataccaatcgcgatttccagagatggatttcttcagttaggctggattggatacaggtgctgcatggctgtcgtcagctcgtgtcgtgagatgttgggttaagtcccgcaacgagcgcaaccctcgccgttagttgccagcaggtttggctgggcactctaacgggaccgccggtgtcaagccggaggaaggtggggatgacgtcaagtcctcatggcccttacgggtagggctacacacgtgctacaatggcggtgacagtgagttaatctctaaaaaccgtctcagttcggattgttctctgcaactcgagagcatgaagttggaatcgctagtaatcgtggatcagcatgccacggtgaatacgttcccgggccttgtacacaccgcccgtcacaccatgggagttggttctacccgaagatggtgcgccaatctggcagccagccacggtagggtcagcgactggggtgaagtcgtaacaaggtagccgtaggggaacctgcggctggatcacctcctttctaa

SEQ ID NO: 4349 - DNA, 1491 bp, Hyphomicrobium denitrificans
  ref <308>: DATABASE ACCESSION NUMBER: NCBI ACCESSION: NC_021172.1
  ref <309>: DATABASE ENTRY DATE: 2019-04-01
  ref <313>: RELEVANT RESIDUES IN SEQ ID NO: (1)..(1491)
tttcaacttgagagtttgatcctggctcagaacgaacgctggcggcaggcctaacacatgcaagtcgaacgccccgcaaggggagtggcagacgggtgagtaacacgtgggaaccttccctatagtacggaatagcccagggaaacttggagtaataccgtatacgcccgaaaggggaaagaatttcgctataggatgggcccgcgtaggattagctagttggtgaggtaatggctcaccaaggcgacgatccttagctggtttgagagaacgaccagccacactgggactgagacacggcccagactcctacgggaggcagcagtggggaatattggacaatgggcgcaagcctgatccagccatgccgcgtgagtgatgaaggccttagggttgtaaagctcttttggcggggacgataatgacggtacccgcagaataagtcccggctaacttcgtgccagcagccgcggtaatacgaaggggactagcgttgttcggaatcactgggcgtaaagcgcacgtaggcggatatgtcagtcaggggtgaaatcccggggctcaacctcggaactgcctttgatacagcatgtcttgagtccgatagaggtgggtggaattcctagtgtagaggtgaaattcgtagatattaggaagaacaccggtggcgaaggcggcccactggatcggtactgacgctgaggtgcgaaagcgtggggagcaaacaggattagataccctggtagtccacgccgtaaacgatggatgctagccgtcggatagcttgctattcggtggcgcagctaacgcattaagcatcccgcctggggagtacggccgcaaggttaaaactcaaaggaattgacgggggcccgcacaagcggtggagcatgtggtttaattcgacgcaacgcgaagaaccttaccagctcttgacattcactgattgccggcagagatgccggagttccagcaatggacagtgggacaggtgctgcatggctgtcgtcagctcgtgtcgtgagatgttgggttaagtcccgcaacgagcgcaaccctcgccattagttgccatcattcagttgggcactctagtgggactgccggtgataagccggaggaaggtggggatgacgtcaagtcatcatggcccttacgggctgggctacacacgtgctacaatggcggtgacaatgcgcagccacctagcaatagggagctaatcgcaaaaagccgtctcagttcagattgaggtctgcaactcgacctcatgaagtcggaatcgctagtaatcgcgcatcagcatggcgcggtgaatacgttcccgggccttgtacacaccgcccgtcacaccatgggagttggtcttaccctaaaacggtgcgctaaccgcaaggaggcagccggccacggtaaggtcagcgactggggtgaagtcgtaacaaggtagccgtaggggaacctgcggctggatcacctcctttctaagga

SEQ ID NO: 4350 - DNA, 1493 bp, Hyphomicrobium nitrativorans
  ref <308>: DATABASE ACCESSION NUMBER: NCBI ACCESSION: NC_022997.1
  ref <309>: DATABASE ENTRY DATE: 2019-04-01
  ref <313>: RELEVANT RESIDUES IN SEQ ID NO: (1)..(1493)
tttcaatttgagagtttgatcctggctcagaacgaacgctggcggcaggcctaacacatgcaagtcgaacgctgtagcaatacagagtggcagacgggtgagtaacacgtgggaatcttcctatcggtacggaatagctcagggaaacttggggtaataccgcatacgcccttcgggggaaagatttatcgccgatagacgagcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgaaagcctgatccagccatgccgcgtgagtgacgaaggtcttcggattgtaaagctcttttggcggggacgataatgacggtacccgcagaataagccccggctaacttcgtgccagcagccgcggtaatacgaagggggctagcgttgttcggaattactgggcgtaaagcgcacgtaggcggattgctaagtcaggggtgaaatcccggggctcaacctcggaactgcctttgatactgacaatcttgagtccggaagaggtgagtggaattcctagtgtagaggtgaaattcgtagatattaggaagaacaccagtggcgaaggcggctcactggtccggtactgacgctgaggtgcgaaagcgtggggagcaaacaggattagataccctggtagtccacgccgtaaactatggatgctagccgtcggcaagcttgcttgtcggtggcgcagctaacgcattaagcatcccgcctggggagtacggccgcaaggttaaaactcaaaggaattgacgggggcccgcacaagcggtggagcatgtggtttaattcgacgcaacgcgaagaaccttaccagctcttgacatttacggaccgtttccagagatggattcatcctagcaataggccgtaggacaggtgctgcatggctgtcgtcagctcgtgtcgtgagatgttgggttaagtcccgcaacgagcgcaaccctcgccattagttgccatcatttagttgggcactctagtgggactgccggtgataagccggaggaaggtggggatgacgtcaagtcatcatggcccttacgggctgggctacacacgtgctacaatggcggtgacaatgggcagcaacacagcgatgtgaagctaatctcaaaaagccgtctcagttcggattggtctctgcaactcgagaccatgaagttggaatcgctagtaatcgcgcatcagcatggcgcggtgaatacgttcccgggccttgtacacaccgcccgtcacaccatgggagttggttttacccgaagacggtgcgctaaccgcaaggaggcagccggccacggtaaggtcagcgactggggtgaagtcgtaacaaggtagccgtaggggaacctgcggctggatcacctcctttctaagg

SEQ ID NO: 4351 - DNA, 1494 bp, Hyphomicrobium sp. 802
  ref <308>: DATABASE ACCESSION NUMBER: NCBI ACCESSION: NZ_JAFM01000001.1
  ref <309>: DATABASE ENTRY DATE: 2019-04-01
  ref <313>: RELEVANT RESIDUES IN SEQ ID NO: (1)..(1494)
tctttcaacttgagagtttgatcctggctcagaacgaacgctggcggcaggcctaacacatgcaagtcgaacgccccgcaaggggagtggcagacgggtgagtaacacgtgggaaccttccctatagtacggaatagcccagggaaacttggagtaataccgtatacgcccgagaggggaaagatttatcgctataggatgggcccgcgtaggattagctagttggtgaggtaatggctcaccaaggcgacgatccttagctggtttgagagaacgaccagccacactgggactgagacacggcccagactcctacgggaggcagcagtggggaatattggacaatgggcgcaagcctgatccagccatgccgcgtgagtgatgaaggccttagggttgtaaagctcttttgccggggacgataatgacggtacccggagaataagtcccggctaacttcgtgccagcagccgcggtaatacgaaggggactagcgttgttcggaatcactgggcgtaaagcgcacgtaggtggatttgtaagtcaggggtgaaatcccggggctcaacctcggaactgcctttgatactgcaagtcttgagtccgatagaggtgggtggaattcctagtgtagaggtgaaattcgtagatattaggaagaacaccggtggcgaaggcggcccactggatcggtactgacactgaggtgcgaaagcgtggggagcaaacaggattagataccctggtagtccacgccgtaaacgatggatgctagccgttggatagcttgctattcggtggcgcagctaacgcattaagcatcccgcctggggagtacggccgcaaggttaaaactcaaaggaattgacgggggcccgcacaagcggtggagcatgtggtttaattcgacgcaacgcgaagaaccttaccagctcttgacattcactgatcgcctggagagatccgggagtcccagcaatgggcagtgggacaggtgctgcatggctgtcgtcagctcgtgtcgtgagatgttgggttaagtcccgcaacgagcgcaaccctcgccattagttgccatcattaagttgggcactctagtgggactgccggtgataagccggaggaaggtggggatgacgtcaagtcatcatggcccttacgggctgggctacacacgtgctacaatggcggtgacaatgcgcagccacctagcaatagggcgctaatcgcaaaaagccgtctcagttcagattgaggtctgcaactcgacctcatgaagtcggaatcgctagtaatcgcgcatcagcatggcgcggtgaatacgttcccgggccttgtacacaccgcccgtcacaccatgggagttggtcttaccctaaaacggtgcgctaaccgcaaggaggcagccggccacggtaaggtcagcgactggggtgaagtcgtaacaaggtagccgtaggggaacctgcggctggatcacctcctttctaagga

SEQ ID NO: 4352 - DNA, 1493 bp, Hyphomicrobium sp. 99
  ref <308>: DATABASE ACCESSION NUMBER: NCBI ACCESSION: NZ_ARWG02000004.1
  ref <309>: DATABASE ENTRY DATE: 2019-04-01
  ref <313>: RELEVANT RESIDUES IN SEQ ID NO: (1)..(1493)
tctttcaacttgagagtttgatcctggctcagaacgaacgctggcggcaggcctaacacatgcaagtcgaacgccccgcaaggggagtggcagacgggtgagtaacacgtgggaaccttccctatagtacggaatagcccagggaaacttggagtaataccgtatacgcccgaaaggggaaagaatttcgctataggatgggcccgcgtaggattagctagttggtgaggtaatggctcaccaaggcgacgatccttagctggtttgagagaacgaccagccacactgggactgagacacggcccagactcctacgggaggcagcagtggggaatattggacaatgggcgcaagcctgatccagccatgccgcgtgagtgatgaaggccttagggttgtaaagctcttttgccggggacgataatgacggtacccggagaataagtcccggctaacttcgtgccagcagccgcggtaatacgaaggggactagcgttgttcggaatcactgggcgtaaagcgcacgtaggcggatttgtaagtcaggggtgaaatcccggggctcaacctcggaactgcctttgatactgcgaatcttgagtccgatagaggtgggtggaattcctagtgtagaggtgaaattcgtagatattaggaagaacaccggtggcgaaggcggcccactggatcggtactgacgctgaggtgcgaaagcgtggggagcaaacaggattagataccctggtagtccacgccgtaaacgatggatgctagccgtcggatagcttgctattcggtggcgcagctaacgcattaagcatcccgcctggggagtacggccgcaaggttaaaactcaaaggaattgacgggggcccgcacaagcggtggagcatgtggtttaattcgacgcaacgcgaagaaccttaccagctcttgacattcactgatcgcctggagagatctgggaattccagcaatggacagtgggacaggtgctgcatggctgtcgtcagctcgtgtcgtgagatgttgggttaagtcccgcaacgagcgcaaccctcgccattagttgccatcattcagttgggcactctagtgggactgccggtgataagccggaggaaggtggggatgacgtcaagtcatcatggcccttacgggctgggctacacacgtgctacaatggcggtgacaatgcgcagccacctagtaatagggagctaatcgcaaaaagccgtctcagttcagattgaggtctgcaactcgacctcatgaagtcggaatcgctagtaatcgcgcatcagcatggcgcggtgaatacgttcccgggccttgtacacaccgcccgtcacaccatgggagttggtcttaccctaaaacggtgcgctaaccgcaaggaggcagccggccacggtaaggtcagcgactggggtgaagtcgtaacaaggtagccgtaggggaacctgcggctggatcacctcctttctaagga

SEQ ID NO: 4353 - DNA, 1490 bp, Hyphomicrobium sp. CS1BSMeth3
  ref <308>: DATABASE ACCESSION NUMBER: NCBI ACCESSION: NZ_FPEI01000006.1
  ref <309>: DATABASE ENTRY DATE: 2019-04-01
  ref <313>: RELEVANT RESIDUES IN SEQ ID NO: (1)..(1490)
ttcaatctgagagtttgatcctggctcagaacgaacgctggcggcaggcctaacacatgcaagtcgaacgccccgcaaggggagtggcagacgggtgagtaacgcgtgggaaccttcccagtggtacggaatagcccagggaaacttggagtaataccgtataatacccgaaaggggaaagatttatcgccattggatgggcccgcgtaggattagctagttggtgaggtaatggctcaccaaggcgacgatccttagctggtctgagaggatgatcagccacactgggactgagacacggcccagactcctacgggaggcagcagtggggaatattgggcaatgggcgcaagcctgacccagccatgccgcgtgagtgacgaaggccttagggttgtaaagctcttttggcggggacgataatgacggtacccgcagaataagccccggctaacttcgtgccagcagccgcggtaatacgaagggggctagcgttgttcggaatcactgggcgtaaagcgcacgtaggcggactttcaagtcaggggtgaaatcccggggctcaacctcggaactgcctttgatactgttggtctcgagtccgatagaggtgggtggaattcctagtgtagaggtgaaattcgtagatattaggaagaacaccggtggcgaaggcggcccactggatcggtactgacgctgaggtgcgaaagcgtggggagcaaacaggattagataccctggtagtccacgccgtaaacgatggatgctagccgtcggcaagcttgcttgtcggtggcgcagctaacgcattaagcatcccgcctggggagtacggccgcaaggttaaaactcaaaggaattgacgggggcccgcacaagcggtggagcatgtggtttaattcgacgcaacgcgaagaaccttaccaagccttgacatgtccggatcggcctttgaaagagggtcttcccagcaatgggccggaacacaggtgctgcatggctgtcgtcagctcgtgtcgtgagatgttgggttaagtcccgcaacgagcgcaaccctcgccattagttgccatcattcagttgggcactctagtgggaccgccggtgataagccggaggaaggtggggatgacgtcaagtcatcatggcccttacggtttgggctacacacgtgctacaatggcggtgacagtgggcagccactcagcaatgaggagctaatcccaaaaagccgtctcagttcggattgggctctgcaactcgagcccatgaagtcggaatcgctagtaatcgcggatcagcacgccgcggtgaatacgttcccgggccttgtacacaccgcccgtcacaccatgggagttggtcttacccgaagacggtacgctaaccgcaaggaggcagccggccacggtaaggtcagcgactggggtgaagtcgtaacaaggtagccgtaggggaacctgcggctggatcacctcctttctaag

SEQ ID NO: 4354 - DNA, 1493 bp, Hyphomicrobium sp. CS1GBMeth3
  ref <308>: DATABASE ACCESSION NUMBER: NCBI ACCESSION: NZ_FPHO01000003.1
  ref <309>: DATABASE ENTRY DATE: 2019-04-01
  ref <313>: RELEVANT RESIDUES IN SEQ ID NO: (1)..(1493)
tttcaatctgagagtttgatcctggctcagaacgaacgctggcggcaggcctaacacatgcaagtcgaacgctgtagcaatacagagtggcagacgggtgagtaacacgtgggaatcttcctatcggtgcggaatagctcagggaaacttggggtaataccgcatacgcccttcgggggaaagatttatcgccgatagatgagcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgacgaaggtcttcggattgtaaagctcttttggcggggacgataatgacggtacccgcagaataagccccggctaacttcgtgccagcagccgcggtaatacgaagggggctagcgttgttcggaattactgggcgtaaagcgcacgtaggcggattgctaagtcaggggtgaaatcccggggctcaacctcggaactgcctttgatactgacagtcttgagtccggaagaggtgagtggaattcctagtgtagaggtgaaattcgtagatattaggaagaacaccagtggcgaaggcggctcactggtccggtactgacgctgaggtgcgaaagcgtggggagcaaacaggattagataccctggtagtccacgccgtaaactatggatgctagccgtcggcaagcttgcttgtcggtggcgcagctaacgctttaagcatcccgcctggggagtacggccgcaaggttaaaactcaaaggaattgacgggggcccgcacaagcggtggagcatgtggtttaattcgacgcaacgcgaagaaccttaccagctcttgacatgtcaggtcggtttccagagatggattcctcccagcaatgggcctgaacacaggtgctgcatggctgtcgtcagctcgtgtcgtgagatgttgggttaagtcccgcaacgagcgcaaccctcgccattagttgccatcatttagttgggcactctagtgggactgccggtgataagccggaggaaggtggggatgacgtcaagtcatcatggcccttacgggctgggctacacacgtgctacaatggcggtgacaatgggcagcaactcagcaatgggaagctaatctcaaaaagccgtctcagttcggattgggctctgcaactcgagcccatgaagttggaatcgctagtaatcgcgcatcagcatggcgcggtgaatacgttcccgggccttgtacacaccgcccgtcacaccatgggagttggttttacccgaagacggtgcgctaaccgcaaggaggcagccggccacggtaaggtcagcgactggggtgaagtcgtaacaaggtagccgtaggggaacctgcggctggatcacctcctttctaagg

SEQ ID NO: 4355 - DNA, 1483 bp, Hyphomicrobium sp. GJ21
  ref <308>: DATABASE ACCESSION NUMBER: NCBI ACCESSION: NZ_CDHO01000001.1
  ref <309>: DATABASE ENTRY DATE: 2019-04-01
  ref <313>: RELEVANT RESIDUES IN SEQ ID NO: (1)..(1483)
caacttgagagtttgatcctggctcagaacgaacgctggcggcaggcctaacacatgcaagtcgaacgccccgcaaggggagtggcagacgggtgagtaacacgtgggaaccttccctatagtacggaatagcccagggaaacttggagtaataccgtatacgcccgaaaggggaaagaatttcgctataggatgggcccgcgtaggattagctagttggtgaggtaatggctcaccaaggcgacgatccttagctggtttgagagaacgaccagccacactgggactgagacacggcccagactcctacgggaggcagcagtggggaatattggacaatgggcgcaagcctgatccagccatgccgcgtgagtgatgaaggccttagggttgtaaagctcttttggcggggacgataatgacggtacccgcagaataagtcccggctaacttcgtgccagcagccgcggtaatacgaaggggactagcgttgttcggaatcactgggcgtaaagcgcacgtaggcggatatgtcagtcaggggtgaaatcccggggctcaacctcggaactgcccttgatacagcatgtcttgagtccgatagaggtgggtggaattcctagtgtagaggtgaaattcgtagatattaggaagaacaccggtggcgaaggcggcccactggatcggtactgacgctgaggtgcgaaagcgtggggagcaaacaggattagataccctggtagtccacgccgtaaacgatggatgctagccgtcggatagcttgctattcggtggcgcagctaacgcattaagcatcccgcctggggagtacggccgcaaggttaaaactcaaaggaattgacgggggcccgcacaagcggtggagcatgtggtttaattcgacgcaacgcgaagaaccttaccagctcttgacattcactgattgccggcagagatgccggagttccagcaatggacagtgggacaggtgctgcatggctgtcgtcagctcgtgtcgtgagatgttgggttaagtcccgcaacgagcgcaaccctcgccattagttgccatcattaagttgggcactctagtgggactgccggtgataagccggaggaaggtggggatgacgtcaagtcatcatggcccttacgggctgggctacacacgtgctacaatggcggtgacaatgcgcagccacctagcaatagggagctaatcgcaaaaagccgtctcagttcagattgaggtctgcaactcgacctcatgaagtcggaatcgctagtaatcgcgcatcagcatggcgcggtgaatacgttcccgggccttgtacacaccgcccgtcacaccatgggagttggtcttaccctaaaacggtgcgctaaccgcaaggaggcagccggccacggtaaggtcagcgactggggtgaagtcgtaacaaggtagccgtaggggaacctgcggctggatcacctcctttct

SEQ ID NO: 4356 - DNA, 1494 bp, Hyphomicrobium sp. MC1; identical to SEQ ID NO: 4351
  ref <308>: DATABASE ACCESSION NUMBER: NCBI ACCESSION: NC_015717.1
  ref <309>: DATABASE ENTRY DATE: 2019-04-01
  ref <313>: RELEVANT RESIDUES IN SEQ ID NO: (1)..(1494)

SEQ ID NO: 4357 - DNA, 1493 bp, Hyphomicrobium sp. NDB2Meth4
  ref <308>: DATABASE ACCESSION NUMBER: NCBI ACCESSION: NZ_FPEJ01000001.1
  ref <309>: DATABASE ENTRY DATE: 2019-04-01
  ref <313>: RELEVANT RESIDUES IN SEQ ID NO: (1)..(1493)
tttcaatctgagagtttgatcctggctcagaacgaacgctggcggcaggcctaacacatgcaagtcgaacgctgtagcaatacagagtggcagacgggtgagtaacgcgtgggaaccttcccaatggtacggaatagctcagggaaacttgaggtaataccgtatattccctatgggggaaagatttatcgccattggatgggcccgcgtcggattagctagttggtggggtaatggcctaccaaggcgacgatccgtagctggtttgagagaatgaccagccacactgggactgagacacggcccagactcctacgggaggcagcagtggggaatcttggacaatgggcgcaagcctgatccagccatgccgcgtgagtgacgaaggccttagggttgtaaagctcttttgccggggacgataatgacggtacccggagaataagtcccggctaacttcgtgccagcagccgcggtaatacgaaggggactagcgttgttcggaattactgggcgtaaagcgcacgtaggcggatttgtaagtcaggggtgaaatcccggggctcaacctcggaactgcctttgatactgcaaatctcgagtccgatagaggtgggtggaattcctagtgtagaggtgaaattcgtagatattaggaagaacaccggtggcgaaggcggcccactggatcggtactgacgctgaggtgcgaaagcgtggggagcaaacaggattagataccctggtagtccacgccgtaaacgatggatgctagccgtcggcaagcttgcttgtcggtggcgcagctaacgcattaagcatcccgcctggggagtacggccgcaaggttaaaactcaaaggaattgacgggggcccgcacaagcggtggagcatgtggtttaattcgacgcaacgcgaagaaccttaccagctcttgacatggtcggtcggtttccagagatggattcctcccagcaatgggccgatacacaggtgctgcatggctgtcgtcagctcgtgtcgtgagatgttgggttaagtcccgcaacgagcgcaaccctcgccattagttgccatcatttagttgggcactctagtgggactgccggtgataagccggaggaaggtggggatgacgtcaagtcatcatggcccttacgggctgggctacacacgtgctacaatggcggtgacagtgggcagcaagccagcgatggtgagctaatctcaaaaagccgtctcagttcggattggtctctgcaactcgagaccatgaagttggaatcgctagtaatcgcggatcagcatgccgcggtgaatacgttcccgggccttgtacacaccgcccgtcacaccatgggagttggctttacccgaagacggtgcgctaaccgcaaggaggcagccggccacggtaaggtcagcgactggggtgaagtcgtaacaaggtagccgtaggggaacctgcggctggatcacctcctttctaagg

SEQ ID NO: 4358 - DNA, 1493 bp, Hyphomicrobium sulfonivorans
  ref <308>: DATABASE ACCESSION NUMBER: NCBI ACCESSION: NZ_LMTR01000048.1
  ref <309>: DATABASE ENTRY DATE: 2019-04-01
  ref <313>: RELEVANT RESIDUES IN SEQ ID NO: (1)..(1493)
tttcaatatgagagtttgatcctggctcagaacgaacgctggcggcaggcctaacacatgcaagtcgaacgccccgcaaggggagtggcagacgggtgagtaacgcgtgggaaccttcccaatggtgcggaatagcccagggaaacttggagtaataccgcataagcccttagggggaaagatttatcgccattggatgggcccgcgtcggattagctagttggtagggtaacggcctaccaaggcgacgatccgtagctggtttgagagaatgaccagccacactgggactgagacacggcccagactcctacgggaggcagcagtggggaatcttggacaatgggcgcaagcctgatccagccatgccgcgtgagtgacgaaggccttagggttgtaaagctcttttgccggggacgataatgacggtacccggagaataagtcccggctaacttcgtgccagcagccgcggtaatacgaaggggactagcgttgttcggaattactgggcgtaaagcgcacgtaggcggattattaagtcaggggtgaaatcccggggctcaacctcggaactgcctttgatactggtaatctagagtccgatagaggtgggtggaattcctagtgtagaggtgaaattcgtagatattaggaagaacaccagtggcgaaggcggcccactggatcggtactgacgctgaggtgcgaaagcgtggggagcaaacaggattagataccctggtagtccacgccgtaaacgatggatgctagccgtcggcaagcttgcttgtcggtggcgcagctaacgcattaagcatcccgcctggggagtacggccgcaaggttaaaactcaaaggaattgacgggggcccgcacaagcggtggagcatgtggtttaattcgacgcaacgcgaagaaccttaccagctcttgacatggtcggtcggtttccagagatggattcctcctagcaataggccgatacacaggtgctgcatggctgtcgtcagctcgtgtcgtgagatgttgggttaagtcccgcaacgagcgcaaccctcgccattagttgccatcattaagttgggcactctagtgggactgccggtgataagccggaggaaggtggggatgacgtcaagtcatcatggcccttacgggctgggctacacacgtgctacaatggcggtgacagtgggcagcaacacagcgatgtgaagctaatctcaaaaagccgtctcagttcggattggtctctgcaactcgagaccatgaagttggaatcgctagtaatcgcggatcagcatgccgcggtgaatacgttcccgggccttgtacacaccgcccgtcacaccatgggagttggttctacccgaaggcgatgcgctaacccgcaagggaggcagtcgaccacggtagggtcagcgactggggtgaagtcgtaacaaggtagccgtaggggaacctgcggctggatcacctcctttctaagg

SEQ ID NO: 4359 - DNA, 1493 bp, Hyphomicrobium zavarzinii
  ref <308>: DATABASE ACCESSION NUMBER: NCBI ACCESSION: NZ_KB911255.1
  ref <309>: DATABASE ENTRY DATE: 2019-04-01
  ref <313>: RELEVANT RESIDUES IN SEQ ID NO: (1)..(1493)
tttcaatctgagagtttgatcctggctcagaacgaacgctggcggcaggcctaacacatgcaagtcgaacgctgtagcaatacagagtggcagacgggtgagtaacacgtgggaatcttcctatcggtacggaatagctcagggaaacttggggtaataccgcatacgcccttcgggggaaagatttatcgccgatagatgagcccgcgtctgattagctagttggtgaggtaatggctcaccaaggcgacgatcagtagctggtctgagaggatgaccagccacactgggactgagacacggcccagactcctacgggaggcagcagtggggaatattggacaatgggcgcaagcctgatccagccatgccgcgtgagtgacgaaggtcttcggattgtaaagctcttttggcggggacgataatgacggtacccgcagaataagccccggctaacttcgtgccagcagccgcggtaatacgaagggggctagcgttgttcggaattactgggcgtaaagcgcacgtaggcggattgctaagtcaggggtgaaatcccggggctcaacctcggaactgcctttgatactgacagtcttgagtccggaagaggtgagtggaattcctagtgtagaggtgaaattcgtagatattaggaagaacaccagtggcgaaggcggctcactggtccggtactgacgctgaggtgcgaaagcgtggggagcaaacaggattagataccctggtagtccacgccgtaaactatggatgctagccgtcggcaagcttgcttgtcggtggcgcagctaacgctttaagcatcccgcctggggagtacggccgcaaggttaaaactcaaaggaattgacgggggcccgcacaagcggtggagcatgtggtttaattcgacgcaacgcgaagaaccttaccagctcttgacatttacggaccgtttccagagatggattcatcctagcaataggccgtaggacaggtgctgcatggctgtcgtcagctcgtgtcgtgagatgttgggttaagtcccgcaacgagcgcaaccctcgccattagttgccatcatttagttgggcactctagtgggactgccggtgataagccggaggaaggtggggatgacgtcaagtcatcatggcccttacgggctgggctacacacgtgctacaatggcggtgacaatgggcagcaacacagcaatgtgaagctaatctcaaaaagccgtctcagttcggattgggctctgcaactcgagcccatgaagttggaatcgctagtaatcgcgcatcagcatggcgcggtgaatacgttcccgggccttgtacacaccgcccgtcacaccatgggagttggttttacccgaagacggtgcgctaaccgcaaggaggcagccggccacggtaaggtcagcgactggggtgaagtcgtaacaaggtagccgtaggggaacctgcggctggatcacctcctttctaagg

SEQ ID NO: 4360 - DNA, 1459 bp, Hyphomonas adhaerens
  ref <308>: DATABASE ACCESSION NUMBER: NCBI ACCESSION: NZ_ARYH01000001.1
  ref <309>: DATABASE ENTRY DATE: 2019-04-01
  ref <313>: RELEVANT RESIDUES IN SEQ ID NO: (1)..(1459)
caacttgagagtttgattctggctcagaacgaacgctggcggcaggcctaacacatgcaagtcgaacgacatagtggcagacgggtgagtaacgcgtgggaacgtacctttcgctacggaatagctcttggaaacgagtggtaataccgtatacgcccttcgggggaaagatttatcggcgaaagatcggcccgcgttagattagtttgttggtggggtaatggcctaccaagactacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgctagggatgataatgacagtacctagtaaagaagccccggctaacttcgtgccagcagccgcggtaatacgaagggggctagcgttgttcggaattactgggcgtaaagcgcacgtaggcggacttttaagtcagatgtgaaatcccggggctcaacctcggaactgcatttgaaactggaagtctggagttcaggagaggttagcggaataccgagtgtagaggtgaaattcgtagatattcggtggaacaccagtggcgaaggcggctaactggactgatactgacgctgaggtgcgaaagtgtggggagcaaacaggattagataccctggtagtccacaccgtaaacgatgacagctagttgttggcaggcatgcctgtcggtgacgcagctaacgcattaagctgtccgcctggggagtacggccgcaaggttaaaactcaaagaaattgacgggggcccgcacaagcggtggagcatgtggtttaattcgaagcaacgcgcagaaccttacctacccttgacatcccgatcgcggtttccagagatggattccttcagttaggctggatcggtgacaggtgctgcatggctgtcgtcagctcgtgtcgtgagatgttgggttaagtcccgcaacgagcgcaaccctcatccttagttgccatcacgtttgggtgggcactctaaggaaactgccggtggcaagccggaggaaggtggggatgacgtcaagtcctcatggcccttacgggtagggctacacacgtgctacaatggcagtgacaatgggataatcccaaaaagctgtctcagttcagattgtcctctgcaactcgagggcatgaaggtggaatcgctagtaatcgtggatcagcatgccacggtgaatacgttcccgggccttgtacacaccgcccgtcacatcatgggaattggctctacccgaagacgctgtgctaacttcggaggcaggcggccacggtagggtcagtgactgggatgaagtcgtaacaaggtagccgtaggggaacctgcggctggatcacctcctttctaa

SEQ ID NO: 4361 - DNA, 1459 bp, Hyphomonas atlantica
  ref <308>: DATABASE ACCESSION NUMBER: NCBI ACCESSION: NZ_AWFH01000061.1
  ref <309>: DATABASE ENTRY DATE: 2019-04-01
  ref <313>: RELEVANT RESIDUES IN SEQ ID NO: (1)..(1459)
caacttgagagtttgattctggctcagaacgaacgctggcggcaggcttaacacatgcaagtcgaacgacatagtggcagacgggtgagtaacgcgtgggaacgtacctttcactacggaatagctcttggaaacgagtggtaataccgtatacgccctccgggggaaagatttatcggtgaaagatcggcccgcgttagattagctagttggtagggtaatggcctaccaaggcgacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgccagggatgataatgacagtacctggtaaagaagccccggctaacttcgtgccagcagccgcggtaatacgaagggggctagcgttgttcggaattactgggcgtaaagcgcacgtaggcggacttttaagtcagatgtgaaatcccggggctcaacctcggaactgcatttgaaactggaagtctagagaccaggagaggttagcggaataccgagtgtagaggtgaaattcgtagatattcggtggaacaccagtggcgaaggcggctaactggactggtactgacgctgaggtgcgaaagtgtggggagcaaacaggattagataccctggtagtccacaccgtaaacgatgagagctagttgttggcaggcatgcctgtcggtgacgcagctaacgcattaagctctccgcctggggagtacggtcgcaagattaaaactcaaagaaattgacgggggcccgcacaagcggtggagcatgtggtttaattcgaagcaacgcgcagaaccttacctacccttgacatcccgatcgcggtttccagagatggattccttcagttaggctggatcggtgacaggtgctgcatggctgtcgtcagctcgtgtcgtgagatgttgggttaagtcccgcaacgagcgcaaccctcatccttagttgccatcacgtttgggtgggcactctaaggaaactgccggtggtaagccggaggaaggtggggatgacgtcaagtcctcatggcccttacgggtagggctacacacgtgctacaatggcagtgacaatgggttaatccccaaaaactgtctcagttcggattgtcgtctgcaactcgacggcatgaaggtggaatcgctagtaatcgtggatcagcatgccacggtgaatacgttcccgggccttgtacacaccgcccgtcacatcatgggaattggttctacccgaagacgctgtgctaacttcggaggcaggcggccacggtaggatcagtgactgggatgaagtcgtaacaaggtagccgtaggggaacctgcggctggatcacctcctttctaa

SEQ ID NO: 4362 - DNA, 1459 bp, Hyphomonas beringensis
  ref <308>: DATABASE ACCESSION NUMBER: NCBI ACCESSION: NZ_AWFF01000065.1
  ref <309>: DATABASE ENTRY DATE: 2019-04-01
  ref <313>: RELEVANT RESIDUES IN SEQ ID NO: (1)..(1459)
caacttgagagtttgattctggctcagaacgaacgctggcggcaggcttaacacatgcaagtcgaacgacatagtggcagacgggtgagtaacgcgtgggaacgtacctttcactacggaatagctcttggaaacgagtggtaataccgtatacgccctccgggggaaagatttatcggtgaaagatcggcccgcgttagattagctagttggtagggtaatggcctaccaaggcgacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgctagggatgataatgacagtacctagtaaagaagccccggctaacttcgtgccagcagccgcggtaatacgaagggggctagcgttgttcggaattactgggcgtaaagcgcacgtaggcggacttttaagtcagatgtgaaatcccagggctcaaccctggaactgcatttgaaactggaagtctagagaccaggagaggttagcggaataccgagtgtagaggtgaaattcgtagatattcggtggaacaccagtggcgaaggcggctaactggactggtactgacgctgaggtgcgaaagtgtggggagcaaacaggattagataccctggtagtccacaccgtaaacgatgagagctagttgttggcaggcatgcctgtcggtgacgcagctaacgcattaagctctccgcctggggagtacggccgcaaggttaaaactcaaagaaattgacgggggcccgcacaagcggtggagcatgtggtttaattcgaagcaacgcgcagaaccttacctacccttgacatcccgatcgcggtttccagagatggattccttcagttaggctggatcggtgacaggtgctgcatggctgtcgtcagctcgtgtcgtgagatgttgggttaagtcccgcaacgagcgcaaccctcatccttagttgccatcacgtttgggtgggcactctaaggaaactgccggtggtaagccggaggaaggtggggatgacgtcaagtcctcatggcccttacgggtagggctacacacgtgctacaatggcagtgacaatgggttaatccccaaaaactgtctcagttcggattgtcgtctgcaactcgacggcatgaaggtggaatcgctagtaatcgtggatcagcatgccacggtgaatacgttcccgggccttgtacacaccgcccgtcacatcatgggaattggttctacccgaagacgctgtgctaacttcggaggcaggcggccacggtaggatcagtgactgggatgaagtcgtaacaaggtagccgtaggggaacctgcggctggatcacctcctttctaa

SEQ ID NO: 4363 - DNA, 1459 bp, Hyphomonas chukchiensis
  ref <308>: DATABASE ACCESSION NUMBER: NCBI ACCESSION: NZ_AWFG01000025.1
  ref <309>: DATABASE ENTRY DATE: 2019-04-01
  ref <313>: RELEVANT RESIDUES IN SEQ ID NO: (1)..(1459)
caacttgagagtttgattctggctcagaacgaacgctggcggcaggcttaacacatgcaagtcgaacgatatagtggcagacgggtgagtaacgcgtgggaacgtacctttcactacggaatagctcttggaaacgagtggtaataccgtatacgccctccgggggaaagatttatcggtgaaagatcggcccgcgttagattagctagttggtagggtaatggcctaccaaggcgacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgctagggatgataatgacagtacctagtaaagaagccccggctaacttcgtgccagcagccgcggtaatacgaagggggctagcgttgttcggaattactgggcgtaaagcgcacgtaggcggacttttaagtcaggtgtgaaatcccagggctcaaccctggaactgcatttgaaactggaagtctagagaccaggagaggttagcggaataccgagtgtagaggtgaaattcgtagatattcggtggaacaccagtggcgaaggcggctaactggactggtactgacgctgaggtgcgaaagtgtggggagcaaacaggattagataccctggtagtccacaccgtaaacgatgagagctagttgttggcaggcatgcctgtcagtgacgcagctaacgcattaagctctccgcctggggagtacggccgcaaggttaaaactcaaagaaattgacgggggcccgcacaagcggtggagcatgtggtttaattcgaagcaacgcgcagaaccttacctacccttgacatgtccagtatggtttccagagatggatcccttcagttaggctggctggaacacaggtgctgcatggctgtcgtcagctcgtgtcgtgagatgttgggttaagtcccgcaacgagcgcaaccctcatccttagttgccatcacgtttgggtgggcactctaaggaaactgccggtggcaagccggaggaaggtggggatgacgtcaagtcctcatggcccttacgggtagggctacacacgtgctacaatggcagtgacaatgggataatccccaaaaactgtctcagttcggattgtcgtctgcaactcgacggcatgaaggtggaatcgctagtaatcgtggatcagcatgccacggtgaatacgttcccgggccttgtacacaccgcccgtcacatcatgggaattggttctacccgaagatcgtgtgctaacttcggaggcagcgagccacggtaggatcagtgactgggatgaagtcgtaacaaggtagccgtaggggaacctgcggctggatcacctcctttctaa

SEQ ID NO: 4364 - DNA, 1458 bp, Hyphomonas hirschiana
  ref <308>: DATABASE ACCESSION NUMBER: NCBI ACCESSION: NZ_ARYI01000011.1
  ref <309>: DATABASE ENTRY DATE: 2019-04-01
  ref <313>: RELEVANT RESIDUES IN SEQ ID NO: (1)..(1458)
caacttgagagtttgattctggctcagaacgaacgctggcggcaggcctaacacatgcaagtcgaacgatatagtggcagacgggtgagtaacgcgtgggaacgtacctttcactacggaatagctctgggaaactggtggtaataccgtatacgcccttagggggaaagatttatcggtgaaagatcggcccgcgttggattagctagttggtgaggtaatggctcacaaaggcgacgatccatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgtcagggatgataatgaccgtacctgaagaagaagccccggctaacttcgtgccagcagccgcggtaatacgaagggggctagcgttgttcggaattactgggcgtaaagcgcacgtaggcggacttttaagtcaggtgtgaaatcccgaggctcaacctcggaactgcatttgaaactggaagtctggagatcaggagaggttagcggaataccgagtgtagaggtgaaattcgtagatattcggtggaacaccagtggcgaaggcggctaactggactgatactgacgctgaggtgcgaaagtgtggggagcaaacaggattagataccctggtagtccacaccgtaaacgatgagagctagttgttggcaggcatgcctgtcggtgacgcagttaacacattaagctctccgcctggggagtacggccgcaaggttaaaactcaaagaaattgacgggggcccgcacaagcggtggagcatgtggtttaattcgaagcaacgcgcagaaccttacctacccttgacatgtctagtatggtttccggagacggattccttcagttcggctggctagaacacaggtgctgcatggctgtcgtcagctcgtgtcgtgagatgttgggttaagtcccgcaacgagcgcaaccctcatccttagttgccatcacgtttgggtgggcactctaaggaaactgccggtggcaagccggaggaaggtggggatgacgtcaagtcctcatggcccttacgggtagggctacacacgtgctacaatggcagtgacaatgggataatcccaaaaagctgtctcagttcggattgtcgtctgcaactcgacggcatgaaggtggaatcgctagtaatcgtggatcagcatgccacggtgaatacgttcccgggccttgtacacaccgcccgtcacatcatgggaattggttctacccgaagatcgtgcgctaacttcggaggcagcgagccacggtaggatcagtaactgggatgaagtcgtaacaaggtagccgtaggggaacctgcggctggatcacctcctttcta

SEQ ID NO: 4365 - DNA, 1459 bp, Hyphomonas jannaschiana
  ref <308>: DATABASE ACCESSION NUMBER: NCBI ACCESSION: NZ_ARYJ01000003.1
  ref <309>: DATABASE ENTRY DATE: 2019-04-01
  ref <313>: RELEVANT RESIDUES IN SEQ ID NO: (1)..(1459)
caacttgagagtttgattctggctcagaacgaacgctggcggcaggcctaacacatgcaagtcgaacgacatagtggcagacgggtgagtaacgcgtgggaacgtacctttcgctacggaatagctcttggaaacgagtggtaataccgtatacgcccttcgggggaaagatttatcggcgaaagatcggcccgcgttagattaggtagttggtggggtaatggcctaccaagcctacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgccagggatgataatgacagtacctggtaaagaagccccggctaacttcgtgccagcagccgcggtaatacgaagggggctagcgttgttcggaattactgggcgtaaagcgcacgtaggcggacttttaagtcagatgtgaaatcccggggctcaacctcggaactgcatttgaaactggaagtctggagttcaggagaggttagcggaataccgagtgtagaggtgaaattcgtagatattcggtggaacaccagtggcgaaggcggctaactggactgatactgacgctgaggtgcgaaagtgtggggagcaaacaggattagataccctggtagtccacaccgtaaacgatgacagctagttgttggcaggcatgcctgtcggtgacgcagctaacgcattaagctgtccgcctggggagtacggccgcaaggttaaaactcaaagaaattgacgggggcccgcacaagcggtggagcatgtggtttaattcgaagcaacgcgcagaaccttacctacccttgacatcccgatcgcggtttccagagatggattccttcagttaggctggatcggtgacaggtgctgcatggctgtcgtcagctcgtgtcgtgagatgttgggttaagtcccgcaacgagcgcaaccctcatccttagttgccatcacgtttgggtgggcactctaaggaaactgccggtggcaagccggaggaaggtggggatgacgtcaagtcctcatggcccttacgggtagggctacacacgtgctacaatggcagtgacaatgggataatcccaaaaagctgtctcagttcagattgtcctctgcaactcgagggcatgaaggtggaatcgctagtaatcgtggatcagcatgccacggtgaatacgttcccgggccttgtacacaccgcccgtcacatcatgggaattggctctacccgaagacgctgtgctaacttcggaggcaggcggccacggtagggtcagtgactgggatgaagtcgtaacaaggtagccgtaggggaacctgcggctggatcacctcctttctaa

SEQ ID NO: 4366 - DNA, 1459 bp, Hyphomonas johnsonii
  ref <308>: DATABASE ACCESSION NUMBER: NCBI ACCESSION: NZ_ARYK01000001.1
  ref <309>: DATABASE ENTRY DATE: 2019-04-01
  ref <313>: RELEVANT RESIDUES IN SEQ ID NO: (1)..(1459)
caacttgagagtttgattctggctcagaacgaacgctggcggcaggcttaacacatgcaagtcgaacgatatagtggcagacgggtgagtaacgcgtggaaacgtacctttcactacggaatagcacttggaaacgagtggtaataccgtatacgccctccgggggaaagatttatcggtgaaagatcggtccgcgttagattagctagttggtagggtaatggcctaccaaggcgacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgctagggatgataatgacagtacctagtaaagaagccccggctaacttcgtgccagcagccgcggtaatacgaagggggctagcgttgttcggaattactgggcgtaaagcgcacgtaggcggactattaagtcagatgtgaaatcccagggctcaaccctggaactgcatttgaaactggtagtctagagaccaggagaggttagcggaataccgagtgtagaggtgaaattcgtagatattcggtggaacaccagtggcgaaggcggctaactggactggtactgacgctgaggtgcgaaagtgtggggagcaaacaggattagataccctggtagtccacaccgtaaacgatgagagctagttgttggcaggcatgcctgtcagtgacgcagctaacgcattaagctctccgcctggggagtacggccgcaaggttaaaactcaaagaaattgacgggggcccgcacaagcggtggagcatgtggtttaattcgaagcaacgcgcagaaccttacctacccttgacataccgatcgcggtttccagagatggattccttcagttaggctggatcggatacaggtgctgcatggctgtcgtcagctcgtgtcgtgagatgttgggttaagtcccgcaacgagcgcaaccctcatccttagttgccatcacgtttgggtgggcactctaaggaaactgccggtggcaagccggaggaaggtggggatgacgtcaagtcctcatggcccttacgggtagggctacacacgtgctacaatggcagtgacaatgggataatccccaaaaactgtctcagttcggattgtcgtctgcaactcgacggcatgaaggtggaatcgctagtaatcgtggatcagcatgccacggtgaatacgttcccgggccttgtacacaccgcccgtcacatcatgggaattggttctacccgaagatcgtgtgctaacttcggaggcagcgagccacggtaggatcagtgactgggatgaagtcgtaacaaggtagccgtaggggaacctgcggctggatcacctcctttctaa

SEQ ID NO: 4367 - DNA, 1458 bp, Hyphomonas neptunium; identical to SEQ ID NO: 4364
  ref <308>: DATABASE ACCESSION NUMBER: NCBI ACCESSION: NC_008358.1
  ref <309>: DATABASE ENTRY DATE: 2019-04-01
  ref <313>: RELEVANT RESIDUES IN SEQ ID NO: (1)..(1458)

SEQ ID NO: 4368 - DNA, 1459 bp, Hyphomonas oceanitis; identical to SEQ ID NO: 4363
  ref <308>: DATABASE ACCESSION NUMBER: NCBI ACCESSION: NZ_ARYL01000041.1
  ref <309>: DATABASE ENTRY DATE: 2019-04-01
  ref <313>: RELEVANT RESIDUES IN SEQ ID NO: (1)..(1459)

SEQ ID NO: 4369 - DNA, 1459 bp, Hyphomonas polymorpha
  ref <308>: DATABASE ACCESSION NUMBER: NCBI ACCESSION: NZ_ARYM01000020.1
  ref <309>: DATABASE ENTRY DATE: 2019-04-01
  ref <313>: RELEVANT RESIDUES IN SEQ ID NO: (1)..(1459)
caacttgagagtttgattctggctcagaacgaacgctggcggcaggcctaacacatgcaagtcgaacgatatagtggcagacgggtgagtaacgcgtgggaacgtacctttcactacggaatagctctgggaaactggtggtaataccgtatacgcccttagggggaaagatttatcggtgaaagatcggcccgcgttggattagctagttggtgaggtaatggctcacaaaggcgacgatccatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgtcagggatgataatgaccgtacctgaagaagaagccccggctaacttcgtgccagcagccgcggtaatacgaagggggctagcgttgttcggaattactgggcgtaaagcgcacgtaggcggacttttaagtcaggtgtgaaatcccggggctcaacctcggaactgcatttgaaactggaagtctggagatcaggagaggttagcggaataccgagtgtagaggtgaaattcgtagatattcggtggaacaccagtggcgaaggcggctaactggactgatactgacgctgaggtgcgaaagtgtggggagcaaacaggattagataccctggtagtccacaccgtaaacgatgagagctagttgttggcaggcatgcctgtcggtgacgcagttaacacattaagctctccgcctggggagtacggccgcaaggttaaaactcaaagaaattgacgggggcccgcacaagcggtggagcatgtggtttaattcgaagcaacgcgcagaaccttacctacccttgacatgtccagtatggtttccagagatggattccttcagttcggctggctggaacacaggtgctgcatggctgtcgtcagctcgtgtcgtgagatgttgggttaagtcccgcaacgagcgcaaccctcatccttagttgccatcacgtttgggtgggcactctaaggaaactgccggtggcaagccggaggaaggtggggatgacgtcaagtcctcatggcccttacgggtagggctacacacgtgctacaatggcagtgacaatgggataatcccaaaaagctgtctcagttcggattgtcgtctgcaactcgacggcatgaaggtggaatcgctagtaatcgtggatcagcatgccacggtgaatacgttcccgggccttgtacacaccgcccgtcacatcatgggaattggttctacccgaagacggtgagctaacttcggaggcagccggccacggtaggatcagtaactgggatgaagtcgtaacaaggtagccgtaggggaacctgcggctggatcacctcctttctaa

SEQ ID NO: 4370 - DNA, 1459 bp, Hyphomonas sp. C76AD
  ref <308>: DATABASE ACCESSION NUMBER: NCBI ACCESSION: NZ_AWFC01000093.1
  ref <309>: DATABASE ENTRY DATE: 2019-04-01
  ref <313>: RELEVANT RESIDUES IN SEQ ID NO: (1)..(1459)
caacttgagagtttgattctggctcagaacgaacgctggcggcaggcttaacacatgcaagtcgaacgacatagtggcagacgggtgagtaacgcgtgggaacgtacctttcactacggaatagctcttggaaacgagtggtaataccgtatacgccctccgggggaaagatttatcggtgaaagatcggcccgcgttagattagctagttggtagggtaatggcctaccaaggcgacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgctagggatgataatgacagtacctagtaaagaagccccggctaacttcgtgccagcagccgcggtaatacgaagggggctagcgttgttcggaattactgggcgtaaagcgcacgtaggcggacttttaagtcaggtgtgaaatcccggggctcaacctcggaactgcatttgaaactggaagtctagagaccaggagaggttagcggaataccgagtgtagaggtgaaattcgtagatattcggtggaacaccagtggcgaaggcggctaactggactggtactgacgctgaggtgcgaaagtgtggggagcaaacaggattagataccctggtagtccacaccgtaaacgatgagagctagttgttggcaggcatgcctgtcggtgacgcagctaacgcattaagctctccgcctggggagtacggccgcaaggttaaaactcaaagaaattgacgggggcccgcacaagcggtggagcatgtggtttaattcgaagcaacgcgcagaaccttacctacccttgacatcccgatcgcggtttccagagatggattccttcagttaggctggatcggtgacaggtgctgcatggctgtcgtcagctcgtgtcgtgagatgttgggttaagtcccgcaacgagcgcaaccctcatccttagttgccatcacgtttgggtgggcactctaaggaaactgccggtggtaagccggaggaaggtggggatgacgtcaagtcctcatggcccttacgggtagggctacacacgtgctacaatggcagtgacaatgggttaatccccaaaaactgtctcagttcggattgtcgtctgcaactcgacggcatgaaggtggaatcgctagtaatcgtggatcagcatgccacggtgaatacgttcccgggccttgtacacaccgcccgtcacatcatgggaattggttctacccgaagacgctgtgctaacttcggaggcaggcggccacggtaggatcagtgactgggatgaagtcgtaacaaggtagccgtaggggaacctgcggctggatcacctcctttctaa

SEQ ID NO: 4371 - DNA, 1459 bp, Hyphomonas sp. CY54-11-8
  ref <308>: DATABASE ACCESSION NUMBER: NCBI ACCESSION: NZ_AWFD01000036.1
  ref <309>: DATABASE ENTRY DATE: 2019-04-01
  ref <313>: RELEVANT RESIDUES IN SEQ ID NO: (1)..(1459)
caacttgagagtttgattctggctcagaacgaacgctggcggcaggcctaacacatgcaagtcgaacgacatagtggcagacgggtgagtaacgcgtgggaacgtacctttcgctacggaatagctcttggaaacgagtggtaataccgtatacgccctccgggggaaagatttatcggcgaaagatcggcccgcgttagattaggtagttggtggggtaatggcctaccaagcctacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgccagggatgataatgacagtacctggtaaagaagccccggctaacttcgtgccagcagccgcggtaatacgaagggggctagcgttgttcggaattactgggcgtaaagcgcacgtaggcggacttttaagtcagatgtgaaatcccggggctcaacctcggaactgcatttgaaactggaagtctggagttcaggagaggttagcggaataccgagtgtagaggtgaaattcgtagatattcggtggaacaccagtggcgaaggcggctaactggactgatactgacgctgaggtgcgaaagtgtggggagcaaacaggattagataccctggtagtccacaccgtaaacgatgacagctagttgttggcaggcatgcctgtcggtgacgcagctaacgcattaagctgtccgcctggggagtacggccgcaaggttaaaactcaaagaaattgacgggggcccgcacaagcggtggagcatgtggtttaattcgaagcaacgcgcagaaccttacctacccttgacatcccgatcgcggtttccagagatggattccttcagttaggctggatcggtgacaggtgctgcatggctgtcgtcagctcgtgtcgtgagatgttgggttaagtcccgcaacgagcgcaaccctcatccttagttgccatcacgtttgggtgggcactctaaggaaactgccggtggcaagccggaggaaggtggggatgacgtcaagtcctcatggcccttacgggtagggctacacacgtgctacaatggcagtgacaatgggataatcccaaaaagctgtctcagttcagattgtcctctgcaactcgagggcatgaaggtggaatcgctagtaatcgtggatcagcatgccacggtgaatacgttcccgggccttgtacacaccgcccgtcacatcatgggaattggctctacccgaagacgctgtgctaacttcggaggcaggcggccacggtagggtcagtgactgggatgaagtcgtaacaaggtagccgtaggggaacctgcggctggatcacctcctttctaa

SEQ ID NO: 4372 - DNA, 1459 bp, Hyphomonas sp. GM-8P; identical to SEQ ID NO: 4371
  ref <308>: DATABASE ACCESSION NUMBER: NCBI ACCESSION: NZ_AWFE01000035.1
  ref <309>: DATABASE ENTRY DATE: 2019-04-01
  ref <313>: RELEVANT RESIDUES IN SEQ ID NO: (1)..(1459)

SEQ ID NO: 4373 - DNA, 1459 bp, Hyphomonas sp. L-53-1-40
  ref <308>: DATABASE ACCESSION NUMBER: NCBI ACCESSION: NZ_AWFI01000001.1
  ref <309>: DATABASE ENTRY DATE: 2019-04-01
  ref <313>: RELEVANT RESIDUES IN SEQ ID NO: (1)..(1459)
caacttgagagtttgattctggctcagaacgaacgctggcggcaggcttaacacatgcaagtcgaacgatatagtggcagacgggtgagtaacgcgtgggaacgtacctttcactacggaatagctcttggaaacgagtggtaataccgtatacgcccttcgggggaaagatttatcggtgaaagatcggcccgcgttagattagctagttggtagggtaatggcctaccaaggcgacgatctatagctggtctgagaggatgatcagccacactgggactgagacacggcccagactcctacgggaggcagcagtggggaatcttgcacaatgggcgaaagcctgatgcagccatgccgcgtgaatgatgaaggccttagggttgtaaaattctttcgctagggatgataatgacagtacctagtaaagaagccccggctaacttcgtgccagcagccgcggtaatacgaagggggctagcgttgttcggaattactgggcgtaaagcgcacgtaggcggacttttaagtcagatgtgaaatcccggggctcaacctcggaactgcatttgaaactggaagtctagagaccaggagaggttagcggaataccgagtgtagaggtgaaattcgtagatattcggtggaacaccagtggcgaaggcggctaactggactggtactgacgctgaggtgcgaaagtgtggggagcaaacaggattagataccctggtagtccacaccgtaaacgatgagagctagttgttggcaggcatgcctgtcggtgacgcagctaacgcattaagctctccgcctggggagtacggtcgcaagattaaaactcaaagaaattgacgggggcccgcacaagcggtggagcatgtggtttaattcgaagcaacgcgcagaaccttacctacccttgacataccgatcgcggtttccagagatggattccttcagttaggctggatcggatacaggtgctgcatggctgtcgtcagctcgtgtcgtgagatgttgggttaagtcccgcaacgagcgcaaccctcatccttagttgccatcacgtttgggtgggcactctaaggaaactgccggtggtaagccggaggaaggtggggatgacgtcaagtcctcatggcccttacgggtagggctacacacgtgctacaatggcagtgacaatgggttaatccccaaaaactgtctcagttcggattgtcgtctgcaactcgacggcatgaaggtggaatcgctagtaatcgtggatcagcatgccacggtgaatacgttcccgggccttgtacacaccgcccgtcacatcatgggaattggttctacccgaagacgctgtgctaacttcggaggcaggcggccacggtaggatcagtgactgggatgaagtcgtaacaaggtagccgtaggggaacctgcggctggatcacctcctttctaa

SEQ ID NO: 4374 - DNA, 1455 bp, Hyphomonas sp. Mor2
  ref <308>: DATABASE ACCESSION NUMBER: NCBI ACCESSION: NZ_CP017718.1
  ref <309>: DATABASE ENTRY DATE: 2019-04-01
  ref <313>: RELEVANT RESIDUES IN SEQ ID NO: (1)..(1455)
caacctgagagtttgattctggctcagaacgaacgctggcggcaggcttaacacatgcaagtcgaacgatatagtggcagacgggtgagtaacgcgtggaaacgtgcctttcactacggaatagcttttggaaacgaaaggtaataccgtatacgccctccgggggaaagatttatcggtgaaagatcggtccgcgttagattagctagttggtgaggtaacggctcaccaaggctacgatctatagctggtctgagaggatgatcagccacactgggactgagacacggcccagactcctacgggaggcagcagtggggaatattgcacaatgggcgcaagcctgatgcagccatgccgcgtgaatgatgaaggccttagggttgtaaaattctttcgccagggatgataatgacagtacctggtaaagaagccccggctaacttcgtgccagcagccgcggtaatacgaagggggctagcgttgttcggaattactgggcgtaaagcgcacgtaggcggacttttaagtcagatgtgaaatcccgaggctcaacctcggaactgcatttgaaactgggagtctagagatcaggagaggttagcggaataccgagtgtagaggtgaaattcgtagatattcggtggaacaccagtggcgaaggcggctaactggactgatactgacgctgaggtgcgaaagtgtggggagcaaacaggattagataccctggtagtccacaccgtaaacgatgagtgctagttgtctgcaggcatgcctgtaggtgacgcagctaacgcattaagcactccgcctggggagtacggccgcaaggttaaaactcaaagaaattgacgggggcccgcacaagcggtggagcatgtggtttaattcgaagcaacgcgcagaaccttacctacgcttgacatgcccggacgatttccagagatggatctctcccttcggggccggtgcacaggtgctgcatggctgtcgtcagctcgtgtcgtgagatgttgggttaagtcccgcaacgagcgcaaccctcatccttagttgccatcacgtttgggtgggcactctagggaaactgccggtgctaagccggaggaaggcggggatgacgtcaagtcctcatggcccttacgcgtagggctacacacgtgctacaatggcagtgacaatgggataatccccaaaagctgtctcagttcggattgtcggctgcaactcgccggcatgaagttggaatcgctagtaatcgtggatcagcatgccacggtgaatacgttcccgggccttgtacacaccgcccgtcacaccatgggagttggatctacccgaagattgtgagctaacttcggaggcagcaagccacggtaggttcagcgactggggtgaagtcgtaacaaggtagccgtaggggaacctgcggctggatcacctcctttctaa

SEQ ID NO: 4375 - DNA, 1459 bp, Hyphomonas sp. ND6WE1B; identical to SEQ ID NO: 4371
  ref <308>: DATABASE ACCESSION NUMBER: NCBI ACCESSION: NZ_LXTV01000175.1
  ref <309>: DATABASE ENTRY DATE: 2019-04-01
  ref <313>: RELEVANT RESIDUES IN SEQ ID NO: (1)..(1459)

SEQ ID NO: 4376 - DNA, 1459 bp, Hyphomonas sp. T16B2; identical to SEQ ID NO: 4370
  ref <308>: DATABASE ACCESSION NUMBER: NCBI ACCESSION: NZ_AWFA01000067.1
  ref <309>: DATABASE ENTRY DATE: 2019-04-01
  ref <313>: RELEVANT RESIDUES IN SEQ ID NO: (1)..(1459)

SEQ ID NO: 4377 - DNA, 1459 bp, Hyphomonas sp. T24B3; identical to SEQ ID NO: 4370
  ref <308>: DATABASE ACCESSION NUMBER: NCBI ACCESSION: NZ_AWFB01000089.1
  ref <309>: DATABASE ENTRY DATE: 2019-04-01
  ref <313>: RELEVANT RESIDUES IN SEQ ID NO: (1)..(1459)

SEQ ID NO: 4378 - DNA, 1537 bp, Ideonella sp. A 288
  ref <308>: DATABASE ACCESSION NUMBER: NCBI ACCESSION: NZ_MWLO01000137.1
  ref <309>: DATABASE ENTRY DATE: 2019-04-01
  ref <313>: RELEVANT RESIDUES IN SEQ ID NO: (1)..(1537)
agatcgaactgaagagtttgatcctggctcagattgaacgctggcggcatgccttacacatgcaagtcgaacggtaacgcggggcaacctggcgacgagtggcgaacgggtgagtaatatatcggaacgtgcccaatagtgggggatagcccggcgaaagccggattaataccgcatacgacctgagggtgaaagcgggggatcgcaagacctcgcgctattggagcggccgatatcagattaggtagttggtgaggtaaaggctcaccaagccgacgatctgtagctggtctgagaggacgaccagccacactgggactgagacacggcccagactcctacgggaggcagcagtggggaattttggacaatgggcgcaagcctgatccagccatgccgcgtgcgggaagaaggccttcgggttgtaaaccgcttttgtcagggaagaaatcttctgagttaatacctcgggaggatgacggtacctgaagaataagcaccggctaactacgtgccagcagccgcggtaatacgtagggtgcaagcgttaatcggaattactgggcgtaaagcgtgcgcaggcggtcttgcaagacaggtgtgaaatccccgggcttaacctgggaactgcacttgtgactgcaaggctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttggacggcttgctgttcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgcctggaatcctgcagagatgtgggagtgctcgaaagagagccaggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcctcatggcccttatgggtagggctacacacgtcatacaatggccggtacagagggctgccaacccgcgagggggagccaatcccagaaaaccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 4379 - DNA, 824 bp, Ideonella sp. KYPY4
  ref <308>: DATABASE ACCESSION NUMBER: NCBI ACCESSION: NZ_SACR01000011.1
  ref <309>: DATABASE ENTRY DATE: 2019-04-01
  ref <313>: RELEVANT RESIDUES IN SEQ ID NO: (1)..(824)
caccgatggcgaaggcaatcccctgggcctgtactgacgctcatgcacgaaagcgtggggagcaaacaggattagataccctggtagtccacgccctaaacgatgtcaactggttgttgggaaggttccttctcagtaacgtagctaacgcgtgaagttgaccgcctggggagtacggccgcaaggttgaaactcaaaggaattgacggggacccgcacaagcggtggatgatgtggtttaattcgacgcaacgcgaaaaaccttacctacccttgacatgtctggaatcctgaagagatttgggggtgctcgaaagagagccagaacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccggtacagagggctgccaacccgcgagggggagccaatcccagaaaaccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggggggcgattaccacggcagggttcgtgactggggtgaagtcgtaacaaggtagccgtatcggaaggtgcggctggatcacctcctttctg

SEQ ID NO: 4380 - DNA, 1008 bp, Ignatzschineria cameli
  ref <308>: DATABASE ACCESSION NUMBER: NCBI ACCESSION: NZ_QEWV01000030.1
  ref <309>: DATABASE ENTRY DATE: 2019-04-01
  ref <313>: RELEVANT RESIDUES IN SEQ ID NO: (1)..(1008)
gaactgaagagtttgatcctggctcagattgaacgctggcggtatgcttaacacatgcaagtcgaacggcagcacgaggagagtttactctcttcggtggcgagtggcggacgggtgagtaatgcataggaatctaccttttagtctaggataactacccgaaagggtggctaatactggatgtggactacggtttaaagcaggggaccttcgggccttgcgctaagagatgagcctatgtgggattagctagttggtgaggtaacggctcaccaaggcgacgatctctagctggtttgagaggatgatcagccacactgggactgagacacggcccagactcctacgggaggcagcagtggggaatattggacaatgggcgaaagcctgatccagcaataccgcgtgtgtgaagaaggccctagggttgtaaagcacttttgttagggagaacgggttttgtaattaatacctacagaatctgatgttacctaaagaataagcaccggctaactccgtgccagcagccgcggtaatacggagggtgcaagcgttaatcggaattactgggcgtaaagggcgcgtaggtggtatcttaagttgggtgtgaaatccccgggctcaacctgggaattgcatccaaaactggggtactagagtgtggtagagggtagcggaatttctggtgtagcggtgaaatgcgtagatatcagaaggaacatcaatggcgaaggcagctacctgggccaacactgacgctgaggcgcgaaagcgtggggagcaaacaggattagataccctggtagtccacgctataaacgatgacaacttgttgatggggacactggtcttcgttgacggagctaacgcattaagttgtccgcctggggagtacggtcgcaaggctgaaactcaaaggaattgacggggacccgcacaagcggtggagcatgtggtttaattcgatgcaacgcgaagaaccttacctggtcttgacatctacagaac

SEQ ID NO: 4381 - DNA, 1541 bp, Ignatzschineria indica
  ref <308>: DATABASE ACCESSION NUMBER: NCBI ACCESSION: NZ_QEWR01000017.1
  ref <309>: DATABASE ENTRY DATE: 2019-04-01
  ref <313>: RELEVANT RESIDUES IN SEQ ID NO: (1)..(1541)
aaactgaagagtttgatcctggctcagattgaacgctggcggtatgcttaacacatgcaagtcgaacggcagcacgaggagagtttactctcttcggtggcgagtggcggacgggtgagtaatgcataggaatctaccttttagtctaggataactacccgaaagggtggctaatactggatgtggactacggtttaaagcaggggatcttcggaccttgcgctaagagatgagcctatgtgggattagctagttggtgaggtaacggctcaccaaggcgacgatctctagctggtttgagaggatgatcagccacactgggactgagacacggcccagactcctacgggaggcagcagtggggaatattggacaatgggcgaaagcctgatccagcaataccgcgtgtgtgaagaaggccctagggttgtaaagcacttttgttagggagaatgggttttgtagctaatatctacagaatctgatgttacctaaagaataagcaccggctaactccgtgccagcagccgcggtaatacggagggtgcaagcgttaatcggaattactgggcgtaaagggcgcgtaggtggtatcttaagttgggtgtgaaatccccgggctcaacctgggaattgcatccaaaactggggtgctagagtgtggtagagggtagcggaatttctggtgtagcggtgaaatgcgtagatatcagaaggaacatcaatggcgaaggcagctacctgggccaacactgacgctgaggcgcgaaagcgtggggagcaaacaggattagataccctggtagtccacgctataaacgatgacaacttgttgatggggacactggtcttcgttgacggagctaacgcgttaagttgtccgcctggggagtacggtcgcaaggctgaaactcaaaggaattgacggggacccgcacaagcggtggagcatgtggtttaattcgatgcaacgcgaagaaccttacctggtcttgacatctacagaactttccagagatggatgggtgccttcgggaactgtaagacaggtgctgcatggctgtcgtcagctcgtgtcgtgagatgttcggttaagtccggcaacgagcgcaacccttgtccttatttgccagcacgtaatggtgggaactctaaggagactgccggtgataaaccggaggaaggtagggacgacgtcaagtcatcatggcccttatgaccagggctacacacgtgctacaatggtcggtacaatgggttgccaaaccgcgaggtggagctaatcccacaaaaccgatcccagtccggattgtagtctgcaactcgactacatgaagtcggaatcgctagtaatcgtggatcagaatgccacggtgaatacgttcccgggtcttgtacacaccgcccgtcacaccatggaagttgattgctccagaagtaggtagcttaaaaatgggcgcttaccacggagtggtcgatgactggggtgaagtcgtaacaaggtagccgtaggggaacctgcggctggatcacctccttta

SEQ ID NO: 4382 - DNA, 1389 bp, Ignatzschineria ureiclastica
  ref <308>: DATABASE ACCESSION NUMBER: NCBI ACCESSION: NZ_QEWQ01000022.1
  ref <309>: DATABASE ENTRY DATE: 2019-04-01
  ref <313>: RELEVANT RESIDUES IN SEQ ID NO: (1)..(1389)
aactacccgaaagggtagctaatacaggatgtggactacggtttaaagcaggggatcttcggaccttgcgctaagagatgagcctatgtgggattagctagttggtgaggtaatggctcaccaaggcgacgatctctagctggtttgagaggatgatcagccacactgggactgagacacggcccagactcctacgggaggcagcagtggggaatattggacaatgggcgcaagcctgatccagcaataccgcgtgtgtgaagaaggccctagggttgtaaagcacttttgttagggagaatgggtttagtagttaatacctactgaatctgatgttacctaaagaataagcaccggctaactccgtgccagcagccgcggtaatacggagggtgcaagcgttaatcggaattactgggcgtaaagggcgcgtaggtggtatcttaagttgggtgtgaaatccccgggctcaacctgggaattgcatccaaaactgggatgctagagtgtggtagagggtagcggaatttctggtgtagcggtgaaatgcgtagatatcagaaggaacatcaatggcgaaggcagctacctgggccaacactgacgctgaggcgcgaaagcgtggggagcaaacaggattagataccctggtagtccacgctgtaaacgatgacaacttgttgatggggacactggtcttcgttgacggagctaacgcgttaagttgtccgcctggggagtacggtcgcaaggctgaaactcaaaggaattgacggggacccgcacaagcggtggagcatgtggtttaattcgatgcaacgcgaagaaccttacctggtcttgacatctacagaactatccagagatggatgggtgccttcgggaactgtaagacaggtgctgcatggctgtcgtcagctcgtgtcgtgagatgttcggttaagtccggcaacgagcgcaacccttgtccttatttgccagcacgtaaaggtgggaactttaaggagactgccggtgataaaccggaggaaggtagggacgacgtcaagtcatcatggcccttatgaccagggctacacacgtgctacaatggtcggtacaatgggttgccaaaccgcgaggtggagctaatctcataaaaccgatcccagtccggattgtagtctgcaactcgactacatgaagtcggaatcgctagtaatcgtggatcagaatgccacggtgaatacgttcccgggtcttgtacacaccgcccgtcacaccatggaagttgattgctccagaagtaggtagcttaaaaatgggcgcttaccacggagtggtcgatgactggggtgaagtcgtaacaaggtagccgtaggggaacctgcggctggatcacctccttta

SEQ ID NO: 4383 - DNA, 1538 bp, Ignavibacterium album
  ref <308>: DATABASE ACCESSION NUMBER: NCBI ACCESSION: NC_017464.1
  ref <309>: DATABASE ENTRY DATE: 2019-04-01
  ref <313>: RELEVANT RESIDUES IN SEQ ID NO: (1)..(1538)
acggagagtttgatcctggctcaggacgaacgctggcggcgtgcttaacacatgcaagtctacgagaaaggggtagcaatatcccgagtaaagtggcgcacgggtgagtaacacgtaagtaatctacctttaggttcggaataactccgagaaatcggtgctaataccggatgatgcagcggatccacatggatatgttgttaaagtctataagacgcctgaagatgagcttgcggccgattagctagttggtggggtaacggcctaccaaggcgacgatcggtagctggtctgagaggatgatcagccacactggaactgagacacggtccagactcctacgggaggcagcagtgaggaatattgggcaatgcccgcaagggtgacccagcaacgccgcgtggaggatgaaggtcgtaagattgtaaactcctgttagaggggacgaataatcccgatagaatcgggacttgactgtaccctcagagaaagccccggctaactacgtgccagcagccgcggtaatacgtagggggcaagcgttgtccggattcactgggtgtaaagggcgcgcaggcgggttagcaagtcagaggtgaaatcctacagcttaactgtagaactgcctttgaaactgttaatcttgagtgcggaagagagagacggaattccaggtgtagcggtgaaatgcgtagatatctggaagaacaccagttgcgaaggcggtctcttggtccgttactgacgctcaggcgcgaaagcgtggggagcaaacaggattagataccctggtagtccacgccctaaacgatgaatactaggtgttggtcccactgggatcagtgccgcagctaacgcattaagtattccacctggggagtacgatcgcaaggttgaaactcaaaggaattgacgggggcccgcacaagcagtggagcatgtggtttaattcgatgcaacgcgaagaaccttacctaggcttgaaaggcagataacagggtatgaaagtacccctcccttcggggcatctgtacaggtgctgcatggctgtcgtcagctcgtgccgtgaggtgttgggttaagtcccgcaacgagcgcaacccctaccattagttgccaccaggttatgctgagcactctaatgggactgcctacgcaagtagtgaggaaggtggggatgacgtcaagtccgcatggcccttacgcctagggctacacacgtgctacaatggatgctacaatgggcagcaagaccgcgaggttaagccaatcccttaaaagcatccccagttcggattggagtctgaaacccgactccatgaagttggaattgctagtaatcgcggatcagcacgccgcggtgaatacgttcccgggccttgtacacaccgcccgtcaagccatggaagccgggggtacccgaagccagtattctaaccccgcaaggggaggaagctgtctaaggtaaaaccggtgactggggctaagtcgtaacaaggtagccgtaccggaaggtgcggctggatcacctcctttct

SEQ ID NO: 4384 - DNA, 1296 bp, Ignavigranum ruoffiae
  ref <308>: DATABASE ACCESSION NUMBER: NCBI ACCESSION: NZ_FOEN01000031.1
  ref <309>: DATABASE ENTRY DATE: 2019-04-01
  ref <313>: RELEVANT RESIDUES IN SEQ ID NO: (1)..(1296)
tttcatgagagtttgatcctggctcaggacgaacgctggcggcgtgcctaatacatgcaagtcgaacgcacaacgaaggagcttgcttcttccgcgtgagtggcgaacgggtgagtaacacgtgggaaacctgccctttagcgggggataacattcggaaacggatgctaataccgcataggccagtgagtcgcctgactcattggggaaagatggttttgctatcactaaaggatggtcccgcggtgcattagctagttggtaaggtaacggcttaccaaggcgatgatgcatagccgacctgagagggtaatcggccacattgggactgagacacggcccaaactcctacgggaggcagcagtagggaatcttccgcaatggacgcaagtctgacggagcaacgccgcgtgtgtgaagaaggatttcggtccgtaaagcactgttgttagagaagaaccatcctgtattaactgtacaggacttgacggtatctaaccagaaagccacggctaactacgtgccagcagccgcggtaatacgtaggtggcaagcgttgtccggatttattgggcgtaaagggagcgcaggtggtggcttaagtctgatgtgaaagcccacggctcaaccgtggaaggtcattggaaactgggtcacttgagtgcagaagaggaaagtggaattccatgtgtagcggtgaaatgcgtagatatatggaggaacaccagtggcgaaggcgactttctggtctgacactgacactgaggctcgaaagcgtggggagcgaacaggattagataccctggtagtccacgctgtaaacgatgaatgttaagtgttggggggcttccacccctcagtgctggcgttaacgcaataaacattccgcctggggagtacggccgcaaggctgaaactcaaaggaattgacggggacccgcacaagcggtggagcatgtggtttaattcgaagcaacgcgaagaaccttaccaggtcttgacatccgctgcatagcttagagataagtgaaatccttcgggacagcgagacaggtggtgcatggttgtcgtcagctcgtgtcgtgagatgttgggttaagtcccgcaacgagcgcaacccttatcattagttaccagcattgagatggggactctaatgagactgccggtgacaaaccggaggaaggtggggatgacgtcaaatcatcatgccccttatgacctgggctacacacgtgctacaatggatggtacaacgagcagcgacctcgtgagagcaagcgaatctcttaaagc

SEQ ID NO: 4385 - DNA, 1532 bp, Ilumatobacter sp. SYSU D60003; identical to SEQ ID NO: 3144
  ref <308>: DATABASE ACCESSION NUMBER: NCBI ACCESSION: NZ_QRDE01000032.1
  ref <309>: DATABASE ENTRY DATE: 2019-04-01
  ref <313>: RELEVANT RESIDUES IN SEQ ID NO: (1)..(1532)

SEQ ID NO: 4386 - DNA, 1531 bp, Ilyobacter polytropus
  ref <308>: DATABASE ACCESSION NUMBER: NCBI ACCESSION: NC_014632.1
  ref <309>: DATABASE ENTRY DATE: 2019-04-01
  ref <313>: RELEVANT RESIDUES IN SEQ ID NO: (1)..(1531)
ttgaatgaagagtttgatcctggctcaggatgaacgctgacagaatgcttaacacatgcaagtcgactggaattcaccttcgggtgatagtacggtggcggacgggtgagtaacgcgtaaagaacttgccctctagactgggacaactgttggaaacgacagctaataccggatattatggaactgcggcatcgcggaactatgaaaggctatatgcgctagaggagagctttgcgtcccattagttagttggtagggtaatggcctaccaagacgatgatgggtagccggcctgagagggtgatcggccacaaggggactgagacacggcccttactcctacgggaggcagcagtggggaatattggacaatggactaaaagtctgatccagcaattctgtgtgcacgatgaaggtcttcggatcgtaaagtgctttcaggtgggaagaagaaagtgacggtaccaccagaagaagcgacggctaaatacgtgccagcagccgcggtaatacgtatgtcgcaagcgttatccggaattattgggcgtaaagcgcgtctaggcggccttttaagtctgatgtgaaaatgcggggctcaactccgtattgcgttggaaactggaaggctagagtatcagagaggtgggcggaactacaagtgtagaggtgaaattcgtagatatttgtaggaatgccgatggggaagccagctcactggatgaatactgacgctaaagcgcgaaagcgtggggagcaaacgggattagataccccggtagtccacgccgtaaacgatgatcactaagtgtggggggtcgaacctccgtgctcaagctaacgcgataagtgatccgcctggggagtacgtacgcaagtatgaaactcaaaggaattgacggggacccgcacaagcggtggagcatgtggtttaattcgacgcaacgcgaggaaccttaccagcccttgacatcccaagaactaggcagagatgcttaggtgcctttcggaggaacttggtgacaggtggtgcatggctgtcgtcagctcgtgtcgtgagatgttgggttaagtcccgcaacgagcgcaacccctatcgtatgttaccatcattaagttggggactcatgcgagactgcctgcgacgagcaggaggaaggtggggatgacgtcaagtcatcatgccccttatgggctgggctacacacgtgctacaatggacaatacagagggtagcgatcccgcgagggggagccaatctcagaaagttgttcttagttcggatcgcagtctgcaactcgactgcgtgaagttggaatcgctagtaatcgcgaatcagcaatgtcgccggtgaatacgttctcgggtcttgtacacaccgcccgtcacaccacgagagttggttgcacctgaagtagcaggcctaacccgtttacgggagggatgttcctaaggtgtgattagcgattggggtgaagtcgtaacaaggtatccgtacgggaacgtgcggatggatcacctcctttctaaggag

SEQ ID NO: 4387 - DNA, 1532 bp, Imhoffiella purpurea
  ref <308>: DATABASE ACCESSION NUMBER: NCBI ACCESSION: NZ_AONC01000053.1
  ref <309>: DATABASE ENTRY DATE: 2019-04-01
  ref <313>: RELEVANT RESIDUES IN SEQ ID NO: (1)..(1532)
ttgaactgaagagtttgatcctggctcagattgaacgctggcggcatgcctaacacatgcaagtcgaacgcgaaagtccttcggggcgagtagagtggcggacgggtgagtaaagcgtgggaatctgcctggcagtgggggataacccggggaaactcgggctaataccgcatacgccctacgggggaaagggggcttcggctcttgttgccagatgagcccacgtccgattagctagttggtggggtaatggcctaccaaggcgacgatcggtagctggtctgagaggatgatcagccacactgggactgagacacggcccagactcctacgggaggcagcagtggggaatattggacaatgggcgaaagcctgatccagcaatgccgcgtgtgtgaagaaggcctgcgggttgtaaagcactttcagcgaggaagaaaagcctgtggttaatacccatgggtcttgacgttactcgcagaagaagcaccggctaactccgtgccagcagccgcggtaatacggagggtgcaagcgttaatcggaatcactgggcgtaaagcgcacgtaggcggtgaggtcagtcagctgtgaaagccccgggcttaacctgggaactgcagttgatactgcctgactagagtctgaaagaggggggtggaattccaggtgtagcggtgaaatgcgtagagatctggaggaacaccagtggcgaaggcggccccctggttcaagactgacgctgaggtgcgaaagcgtggggagcaaacaggattagataccctggtagtccacgctgtaaacgctgtcgactagccgtggggctcatttaagggtttcgtggcgcagctaacgcgataagtcgaccgcctggggagtacggccgcaaggttaaaactcaaaggaattgacgggggcccgcacaagcggtggagcatgtggtttaattcgatgcaacgcgaagaaccttaccagcccttgacatcctcggaacttggcagagatgccttggtgccttcgggagccgagagacaggtgctgcatggctgtcgtcagctcgtgtcgtgagatgttgggttaagtcccgtaacgagcgcaacccttgtccttagttgccagcatttcggatgggaactctaaggagactgccggtgataaaccggaggaaggtggggatgacgtcaagtcatcatggcccttatgggctgggctacacacgtgctacaatggtcggtacagagggttgcgaagcggcgacgtggagccaatcccagaaaaccggtcgtagtccggattgcagtctgcaactcgactgcatgaagtcggaatcgctagtaatcgcgaatcagcatgtcgcggtgaatacgttcccgggccttgtacacaccgcccgtcacaccatgggagttggttgcaccagaagtagatagcttaaccttcgggagggcgtttaccacggtgtggtcaatgactggggtgaagtcgtaacaaggtagccgtaggggaacctgcggctggatcacctccttact

SEQ ID NO: 4388 - DNA, 1523 bp, Indibacter alkaliphilus
  ref <308>: DATABASE ACCESSION NUMBER: NCBI ACCESSION: NZ_ALWO02000055.1
  ref <309>: DATABASE ENTRY DATE: 2019-04-01
  ref <313>: RELEVANT RESIDUES IN SEQ ID NO: (1)..(1523)
tacaatggagagtttgatcctggctcaggatgaacgctagcggcaggcctaatacatgcaagttgaacggtatcatcgggcttgcctgatgagagagtggcgcacgggtgcgtaacgcgtatgcaacctgcctgttaccgggggatagcccggggaaacccggattaataccccatggtattgggagatggcatcatcacccgattaaagatttatcggtaacagatgggcatgcgtaggattagttagttggtaaggtaacggcttaccaaggcgatgatccttaggggttctgagaggaaggtcccccacactggcactgagacacgggccagactcctacgggaggcagcagtagggaatattgggcaatggacggaagtctgacccagccatgccgcgtgcaggaagacggccttacgggttgtaaactgcttttatcagggaagaaaaagccactgcggtggaaattgccggtacctgatgaataagcaccggctaactccgtgccagcagccgcggtaatacggagggtgcgagcgttgtccggatttattgggtttaaagggtgcgtaggcggccttataagtcagcggtgaaagtttggggctcaaccctaaaattgccgttgatactgtttggcttgagtgcggtctgggtacatggaatttatggtgtagcggtgaaatgcatagataccataaggaacaccgatagcgtaggcattgtactggtccgcaactgacgctgatgcacgaaagcgcgggtagcgaacaggattagataccctggtagtccgcgccgtaaacgatgattactcgctgttattcctttatggtgtagcggccaagcgaaagcgttaagtaatccacctggggagtacgccggcaacggtgaaactcaaaggaattgacgggggtccgcacaagcggtggagcatgtggtttaattcgatgatacgcgaggaaccttacccgggctagaatgtgaccgcatcacccagagatgggtgagtccgcaaggacggaaaacaaggtgctgcatggctgtcgtcagctcgtgccgtgaggtgttgggttaagtcccgcaacgagcgcaacccctattgtcagttgccatcaggttaagctggggactctgacaagactgcctgcgcaagcagagaggaaggaggggacgacgtcaagtcatcatggcccttacgcccggggcgacacacgtgctacaatggcgcatacagcgggtagctacctggcaacaggatgccaacctctaaaagtgcgtctcagttcggatcggggcctgcaacccggccccgtgaagctggaatcgctagtaatcgcgcatcagccatggcgcggtgaatacgttcccggaccttgtacacaccgcccgtcaagccatggaagtcgggtagacctgaaggcggtaaccgcgaggagccgtcaagggtagaaccggtaactggggctaagtcgtaacaaggtagccgtaccggaaggtgcggctggaacacctccttt

SEQ ID NO: 4389 - DNA, 1492 bp, Indioceanicola profundi
  ref <308>: DATABASE ACCESSION NUMBER: NCBI ACCESSION: NZ_CP030126.1
  ref <309>: DATABASE ENTRY DATE: 2019-04-01
  ref <313>: RELEVANT RESIDUES IN SEQ ID NO: (1)..(1492)
tcaaacctgagagtttgatcctggctcagaacgaacgctggcggcaggcctaacacatgcaagtcgaacgaaggcttcggccttagtggcgcacgggtgagtaacgcgtgggaacgtgccctttggtctgggataacgtctggaaacggacgctaataccggatgagccctctgggggaaagatttatcgccaagggagcggcccgcgtctgattagctagttggtggggtaatggcccaccaaggcgacgatcagtagctggtctgagaggatgatcagccacactgggactgagacacggcccagactcctacgggaggcagcagtggggaatattggacaatgggggcaaccctgatccagccatgccgcgtgagtgatgaaggccttcgggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcgcttcaagtcagatgtgaaagccccgggctcaacctgggaacagcatttgagactggagtgcttgagttccggagaggtgggtggaattcccagtgtagaggtgaaattcgtagatattgggaagaacaccggtggcgaaggcggcccactggacggatactgacgctgaggcgcgaaagcgtggggagcaaacaggattagataccctggtagtccacgccgtaaacgatgtcggctagacgttggggctcttagagcttcggtgtcgcagctaacgcattaagccgaccgcctggggagtacggccgcaaggttgaaactcaaaggaattgacgggggcccgcacaagcggtggagcatgtggtttaattcgaagcaacgcgcagaaccttaccagcccttgacatgcctggaccggcgcagagatgcgctttcctcttcggaggccgggacacaggtgctgcatggctgtcgtcagctcgtgtcgtgagatgttgggttaagtcccgcaacgagcgcaaccctcatcgtcagttgccatcatttggttgggcactctggcgaaactgccgctgacaaggcggaggaaggcggggatgacgtcaagtcctcatggcccttacgggctgggctacacacgtgctacaatggtggtgacagtgggcagcgaccctgcgaagggaagcgaatctccaaaagccatctcagttcggattgcactctgcaactcgggtgcatgaagttggaatcgctagtaatcgcggatcagcacgccgcggtgaatacgttcccgggccttgtacacaccgcccgtcacaccatgggagttggctttacccgaagccggtgcgctaacccgtaagggaggcagccgaccacggtacggtcagcgactggggtgaagtcgtaacaaggtagccgtaggggaacctgcggctggatcacctcctttctaag

SEQ ID NO: 4390 - DNA, 1531 bp, Inediibacterium massiliense
  ref <308>: DATABASE ACCESSION NUMBER: NCBI ACCESSION: NZ_LN876583.1
  ref <309>: DATABASE ENTRY DATE: 2019-04-01
  ref <313>: RELEVANT RESIDUES IN SEQ ID NO: (1)..(1531)
tttaattgagagtttgatcctggctcaggatgaacgctggcggcgtgcctaacacatgcaagtcgagcgaacaaatttttaggaagccttcgggtggaataaaaaggagttagcggcggacgggtgagtaacgcgtgggcaacctgccctatacagagggatagcctcgggaaaccgggattaatacctcataaaactctagtatggcatcatataggagtcaaagatttatcggtataggatgggcccgcgtctgattagctagttggtaaggtaacggcttaccaaggcaacgatcagtagccgacctgagagggtgatcggccacattggaactgagacacggtccaaactcctacgggaggcagcagtggggaatattgcacaatgggcgcaagcctgatgcagcaacgccgcgtgagtgatgaaggccttcgggtcgtaaaactctgtcctaagggaagaataatgacggtaccttaggaggaagccccggctaactacgtgccagcagccgcggtaatacgtagggggcgagcgttatccggaatcactgggcgtaaagggtgcgtaggcggtcagtaaagtctggggtgaaaggctacggcttaaccgtagtaagccttggaaacttactgacttgagtgcaggagaggagagcggaattcctagtgtagcggtgaaatgcgtagatattaggaggaacaccagtggcgaaggcggctctctggactgtaactgacgctgaggcacgaaagcgtgggtagcgaacaggattagataccctggtagtccacgccgtaaacgatgagtgctaggtgtcgggggttacccccctcggtgccgcagttaacgcaataagcactccgcctggggagtacggtcgcaagactgaaactcaaaggaattgacggggacccgcacaagcagcggagcatgtggtttaattcgaagcaacgcgaagaaccttaccaggacttgacatcctctgcattacccttaatcggggaaatcccttcggggacagagagacaggtggtgcatggttgtcgtcagctcgtgtcgtgagatgttgggttaagtcccgcaacgagcgcaacccttgtctttagttgccagcactttgggtgggcactctaaagagaccgccgaggataactcggaggaaggtggggatgacgtcaaatcatcatgccccttatgttctgggctacacacgtgctacaatggctggtacaacgggtagcgaaagagtaatctggagccaatcttaaaagccagtctcagttcggattgtgggctgcaactcgcccacatgaagctggagttgctagtaatcgcggatcagaatgtcgcggtgaatgcgttcccgggtcttgtacacaccgcccgtcacaccatgggagttgggggcacccgaagtcagcgatctaaccgcaaggaagaagctgccgaaggtgaaatcaataactagggtgaagtcgtaacaaggtagccgtatcggaaggtgcggctggatcacctcctttct

SEQ ID NO: 4391 - DNA, 1538 bp, Inhella sp. CCP-18
  ref <308>: DATABASE ACCESSION NUMBER: NCBI ACCESSION: NZ_SACM01000007.1
  ref <309>: DATABASE ENTRY DATE: 2019-04-01
  ref <313>: RELEVANT RESIDUES IN SEQ ID NO: (1)..(1538)
agatcgaactgtagagtttgatcctggctcagattgaacgctggcggcatgccttacacatgcaagtcgaacggtaacgcggggcaacctggcgacgagtggcgaacgggtgagtaatgcatcggaacgtgcctggtagtgggggataactgctcgaaagagcagctaataccgcatacgacctgagggtgaaagggggggatcgcaagacctctcgctatcagagcggccgatgtcggattagctagttggtggggtaaaggcccaccaaggcgacgatccgtagctggtctgagaggacgaccagccacactgggactgagacacggcccagactcctacgggaggcagcagtggggaattttggacaatggacgcaagtctgatccagccatgccgcgtgcgggaagaaggccttcgggttgtaaaccgcttttgtcagggaagaaatcttctgggttaatacctcgggaggatgacggtacctgaagaataagcaccggctaactacgtgccagcagccgcggtaatacgtagggtgcaagcgttaatcggaattactgggcgtaaagcgtgcgcaggcggttatgcaagacaggtgtgaaatccccgagctcaacttgggaactgcacttgtgactgcatagctagagtacggtagaggggagtggaattccgcgtgtagcagtgaaatgcgtagatatgcggaggaacaccgatggcgaaggcaactccctggacctgtactgacgctcatgcacgaaagcgtggggagcaaacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgtctggaatcctgtagagatatgggagtgctcgcaagagagccagaacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcctcatggcccttatgggtagggctacacacgtcatacaatggccgggacagagggctgccaacccgcgagggggagccaatcccagaaacccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctag

SEQ ID NO: 4392 - DNA, 1552 bp, Inmirania thermothiophila
  ref <308>: DATABASE ACCESSION NUMBER: NCBI ACCESSION: NZ_RJVI01000003.1
  ref <309>: DATABASE ENTRY DATE: 2019-04-01
  ref <313>: RELEVANT RESIDUES IN SEQ ID NO: (1)..(1552)
aaactgaagagtttgatcctggctcagattgaacgctggcggcatgcctaacacatgcaagtcgtacggcagcgcggggaagcttgcttccctggcggcgagtggcgaacgggtgagtaacgcgtaggaacctgccctgcagtgggggataacctggggaaactcaggctaataccgcatacaccctacgggggaaagcgggggatctcttcggagacctcgcgctgcaggatgggcctgcgtccgattagcttgttggtgaggtaatggctcaccaaggcgacgatcggtagctggtctgagaggatgatcagccacactgggactgagacacggcccagactcctacgggaggcagcagtggggaatattggacaatgggcgaaagcctgatccagcaatgccgcgtgggtgaagaaggccttcgggttgtaaagccctttcggtggggaagaaaagcggagggctaatacctctccgtcttgacgttacccacagaagaagcaccggctaactccgtgccagcagccgcggtaatacggagggtgcgagcgttaatcggaattactgggcgtaaagggcgtgtaggcggcctggtaagtcgggtgtgaaagccctgggctcaacccgggaattgcatccgatactgccaggctagagtgtggtagaggggagcggaattcccggtgtagcggtgaaatgcgtagatatcgggaggaacaccagtggcgaaggcggctccctggaccaacactgacgctgaggcgcgaaagcgtggggagcaaacaggattagataccctggtagtccacgccgtaaacgatgaggactagccgttgggaaggttcagcttctcagtggcgcagctaacgcgttaagtcctccgcctggggagtacggccgcaaggttaaaactcaaaggaattgacgggggcccgcacaagcggtggagcatgtggtttaattcgatgcaacgcgaagaaccttacctgcccttgacatccccggaatcccccagagatgggggagtgccttcgggaaccgggtgacaggtgctgcatggctgtcgtcagctcgtgtcgtgagatgttgggttaagtcccgtaacgagcgcaacccttgcccctagttgccagcggttcggccgggaactctagggggactgccggtgacaaaccggaggaaggtggggatgacgtcaagtcatcatggcccttatgggcagggctacacacgtgctacaatggccggtacagagggtcgcgaacccgcgagggggagccaatcccagaaaaccggtcgtagtccggattggagtctgcaactcgactccatgaagtcggaatcgctagtaatcgcgaatcagcatgtcgcggtgaatacgttcccgggccttgtacacaccgcccgtcacaccatgggagtcggctgcaccagaagcaggtagcttaacccttcggggagggcgcttgccacggtgtggtcgatgactggggtgaagtcgtaacaaggtagccgtacgggaacgtgcggctggatcacctcctttcaa

SEQ ID NO: 4393 - DNA, 1495 bp, Insolitispirillum peregrinum
  ref <308>: DATABASE ACCESSION NUMBER: NCBI ACCESSION: NZ_FTOA01000018.1
  ref <309>: DATABASE ENTRY DATE: 2019-04-01
  ref <313>: RELEVANT RESIDUES IN SEQ ID NO: (1)..(1495)
gtcaacttgagagtttgatcctggctcagaacgaacgctggcggcaggcctaacacatgcaagtcgatcgctgtcttcggacagagaggcgcacgggtgagtaacacgtgggaacatacccttgagtgcggaataactattggaaacgatagctaataccgcatacgccctacgggggaaagatttatcgctcaaggattggcccgcgtccgattagctagttggcggggtaacggcccaccaaggcgacgatcggtagctggtttgagagaatgatcagccacactgggactgagacacggcccagactcctacgggaggcagcagtggggaatattggacaatgggcgcaagcctgatccagccatgccgcgtgagtgaagaaggccttcgggttgtaaagctctttcagacgtgacgatgatgacggtagcgtcagaagaagccccggctaacttcgtgccagcagccgcggtaatacgaagggggcaagcgttgttcggaattactgggcgtaaagcgcgcgtaggcggcgtcgtcagtcagaggtgaaatcccagggctcaaccttggaattgcctttgatactgcgatgcttgagttcgagagagggtggcggaatacccagtgtagaggtgaaattcgtagatattgggtagaacaccagtggcgaaggcggccacctggctcgatactgacgctgaggtgcgaaagcgtggggagcaaacaggattagataccctggtagtccacgccgtaaacgatgagtgctagctgttggaatgcatgcatttcagtggcgcagctaacgcattaagcactccgcctggggagtacggtcgcaagattaaaactcaaaggaattgacgggggcccgcacaagcggtggagcatgtggtttaattcgaagcaacgcgcagaaccttaccagcccttgacatcgggatcgcgacctccagagatggaagtcttcagttcggctggatcctggacaggtgctgcatggctgtcgtcagctcgtgtcgtgagatgttgggttaagtcccgcaacgagcgcaaccctcactttcagttgccatcattcagttgggcactctgaagggactgccggtgacaagccggaggaaggtggggatgacgtcaagtcctcatggcccttacgggctgggctacacacgtgctacaatggtggatacaatgggcagcgaacccgcgagggcaagcgaatctccaaagtccatctcagttcggattgtactctgcaactcgagtacatgaagtcggaatcgctagtaatcgtagatcagcatgctacggtgaatacgttcccgggccttgtacacaccgcccgtcacaccatgggagttggttttacccgaaggcggttcgctaaccttttaggaggcagccgaccacggtaaggtcagtgactggggtgaagtcgtaacaaggtagccgtaggggaacctgcggctggatcacctcctttcaagga

SEQ ID NO: 4394 - DNA, 1535 bp, Intestinibacillus sp. Marseille-P4005
  ref <308>: DATABASE ACCESSION NUMBER: NCBI ACCESSION: NZ_OMPN01000001.1
  ref <309>: DATABASE ENTRY DATE: 2019-04-01
  ref <313>: RELEVANT RESIDUES IN SEQ ID NO: (1)..(1535)
tttttagagagtttgatcctggctcaggatgaacgctggcggcgtgcctaacacatgcaagtcgaacggggttattttggaaatctcttcggagatggaattcttaacctagtggcggacgggtgagtaacgcgtgagcaatctgcctttaggagggggataacagtcggaaacggctgctaataccgcataatacgtttgggaggcatctcttgaacgtcaaagattttatcgcctttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatggggggaaccctgacgcagcaacgccgcgtgattgaagaaggccttcgggttgtaaagatctttaatcagggacgaaaaatgacggtacctgaagaataagctccggctaactacgtgccagcagccgcggtaatacgtagggagcaagcgttatccggatttactgggtgtaaagggcgcgcaggcgggccggcaagttgggagtgaaatcccggggcttaaccccggaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccggcgtagagatatgccctctcttcggagcatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaataccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgcaaggggggcgcggccgaaggtaggggtggtaattagggtgaagtcgtaacaaggtagccgtatcggaaggtgcggctggatcacctcctttctaagga

SEQ ID NO: 4395 - DNA, 1535 bp, Intestinibacillus sp. Marseille-P6563
  ref <308>: DATABASE ACCESSION NUMBER: NCBI ACCESSION: NZ_UWOD01000001.1
  ref <309>: DATABASE ENTRY DATE: 2019-04-01
  ref <313>: RELEVANT RESIDUES IN SEQ ID NO: (1)..(1535)
tttttagagagtttgatcctggctcaggatgaacgctggcggcgtgcctaacacatgcaagtcgaacggagttattttggaaatctcttcggagatggaattcttaacttagtggcggacgggtgagtaacgcgtgagcaatctgcctcggagtgggggataacagtcggaaacgactgctaataccgcataatgcatcgggatcgcatggttctgatgccaaaggcttgtctgctctgagatgagctcgcgtctgattagctagttggcggggtaacggcccaccaaggcgacgatcagtagccggactgagaggttgaacggccacattgggactgagacacggcccagactcctacgggaggcagcagtggggaatattgcgcaatgggggcaaccctgacgcagcaacgccgcgtgattgaagaaggccttcgggttgtaaagatctttaatcagggacgaattttgacggtacctgaagaataagctccggctaactacgtgccagcagccgcggtaatacgtagggagcaagcgttatccggatttactgggtgtaaagggcgagtaggcgggctggtaagttgggagtgaaatcccggggcttaaccccggaactgctttcaaaactgctggtcttgagtgatggagaggcaggcggaattcccagtgtagcggtgaaatgcgtagatattggggggaacaccagtggcgaaggcggcctgctggacattaactgacgctgaggagcgaaagcgtggggagcaaacaggattagataccctggtagtccacgccgtaaacgatggatactaggtgtgggaggtattgaccccttccgtgccggagttaacacaataagtatcccacctggggagtacgaccgcaaggttgaaactcaaaggaattgacgggggcccgcacaagcagtggagtatgtggtttaattcgaagcaacgcgaagaaccttaccaggtcttgacatccctctgaccgccctagagatagggtttcccttcggggcagaggtgacaggtggtgcatggttgtcgtcagctcgtgtcgtgagatgttgggttaagtcccgcaacgagcgcaacccttacggttagttgctacgcaagagcactctagccggactgccgttgacaaaacggaggaaggtggggacgacgtcaaatcatcatgccccttatgacctgggctacacacgtactacaatggcagtcatacagagggaggcaataccgcgaggtggagcaaatccctaaaagctgtcccagttcagattgcaggctgcaactcgcctgcatgaagtcggaattgctagtaatcgcggatcagcatgccgcggtgaatacgttcccgggccttgtacacaccgcccgtcacaccatgagagccggtaatacccgaagtccgtagcctaaccgcaaggagggcgcggccgaaggtaggactggtaattagggtgaagtcgtaacaaggtagccgtatcggaaggtgcggctggatcacctcctttctaagga

SEQ ID NO: 4396 - DNA, 306 bp, Intestinibacter bartlettii
  ref <308>: DATABASE ACCESSION NUMBER: NCBI ACCESSION: NZ_FUXV01000003.1
  ref <309>: DATABASE ENTRY DATE: 2019-04-01
  ref <313>: RELEVANT RESIDUES IN SEQ ID NO: (1)..(306)
tttattttgagagtttgatcctggctcaggatgaacgctggcggcgtgcctaacacatgcaagtcgagcgattctcttcggagaagagcggcggacgggtgagtaacgcgtgggtaacctgccctgtacacacggataacataccgaaaggtatgctaatacgggataacataagaaattcgcatgtttttcttatcaaagctccggcggtacaggatggacccgcgtctgattagctagttggtgaggtaacggctcaccaaggcgacgatcagtagccgacctgagagggtgatcggccacatt

SEQ ID NO: 4397 - DNA, 1539 bp, Intestinimonas butyriciproducens
  ref <308>: DATABASE ACCESSION NUMBER: NCBI ACCESSION: NZ_CP011524.1
  ref <309>: DATABASE ENTRY DATE: 2019-04-01
  ref <313>: RELEVANT RESIDUES IN SEQ ID NO: (1)..(1539)
tttattgagagtttgatcctggctcaggatgaacgctggcggcgtgcttaacacatgcaagtcgaacggagcacccctgacggagttttcggacaacgaaagggaatgcttagtggcggacgggtgagtaacgcgtgagtaacctgccttggagtggggaataacagccggaaacggctgctaataccgcatgatgtatctggatcgcatggttctggataccaaagatttatcgctctgagatggactcgcgtctgattagctagttggtgaggtaacggctcaccaaggcgacgatcagtagccggactgagaggttggccggccacattgggactgagacacggcccagactcctacgggaggcagcagtggggaatattgggcaatgggcgaaagcctgacccagcaacgccgcgtgaaggaagaaggccctcgggttgtaaacttcttttgtcagggacgaagcaagtgacggtacctgacgaataagccacggctaactacgtgccagcagccgcggtaatacgtaggtggcaagcgttatccggatttactgggtgtaaagggcgtgtaggcgggagtgcaagtcagatgtgaaaactatgggctcaacccatagcctgcatttgaaactgtacttcttgagtgatggagaggcaggcggaattccctgtgtagcggtgaaatgcgtagatatagggaggaacaccagtggcgaaggcggcctgctggacattaactgacgctgaggcgcgaaagcgtggggagcaaacaggattagataccctggtagtccacgccgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccaggacttgacatcctactaacgaagcagagatgcataaggtgcccttcggggaaagtagagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccccttatgtcctgggccacacacgtactacaatggcggtcaacagagggaagcaaagccgcgaggtggagcaaatccctaaaagccgtcccagttcggattgcaggctgaaactcgcctgtatgaagtcggaatcgctagtaatcgcggatcagcatgccgcggtgaatacgttcccgggccttgtacacaccgcccgtcacaccatgagagtcgggaacacccgaagtccgtagcctaacagcaatgggggcgcggccgaaggtgggttcgataattggggtgaagtcgtaacaaggtagccgtatcggaaggtgcggctggatcacctcctttctaagga

SEQ ID NO: 4398 - DNA, 1538 bp, Iodobacter sp. H11R3
  ref <308>: DATABASE ACCESSION NUMBER: NCBI ACCESSION: NZ_CP034433.1
  ref <309>: DATABASE ENTRY DATE: 2019-04-01
  ref <313>: RELEVANT RESIDUES IN SEQ ID NO: (1)..(1538)
aaactaaagagtttgatcctggctcagattgaacgctggcggcatgctttacacatgcaagtcgaacggtaacaggctgcttgcagcgctgacgagtggcgaacgggtgagtaatatatcggaacgtacctagtaatgggggataactatccgaaaggatagctaataccgcatacgccctgagggggaaagagggggatcgcaagacctctcgttattagagcggccgatatcagattagctagttggtgaggtaaaggctcaccaaggcgacgatctgtagcgggtcttagaggacgatccgccacactggaactgagacacggtccagactcctacgggaggcagcagtggggaatcttggacaatgggcgcaagcctgatccagcaatgccgcgtgcgtgaagaaggccttcgggttgtaaagcgcttttgtccgggaggaaatcctaagagctaatatcttttggggatgacagtaccggaagaataaggaccggctaactacgtgccagcagccgcggtaatacgtagggtccaagcgttaatcggaattactgggcgtaaagggtgcgcaggtggttgattaagtgtgatgtgaaagccccgggctcaacctgggaattgcattgcaaactggtgaactagagtatggcagaggggggtggaattccgcgtgtagcagtgaaatgcgtagagatgcggaggaacaccgatggcgaaggcaaccccctgggctaatactgacactcatgcacgaaagcgtggggagcaaacaggattagataccctggtagtccacgccctaaacgatgtctactagttgttggggaattcgttccttagtaacgcagctaacgcgtgaagtagaccgcctggggagtacggccgcaaggctaaaactcaaaggaattgacgggggcccgcacaagcggtggatgatgtggattaattcgatgcaacgcgaaaaaccttacctagccttgacatgtcaagaacctctgagagattggggggtgccgcaaggaacttgaacacaggtgctgcatggctgtcgtcagctcgtgtcgtgagatgttgggttaagtcccgcaacgagcgcaacccttgtccttagttgccatcatttggttgggcactttaaggagactgccggtgacaaaccggaggaaggtggggatgacgtcaagtcctcatggcccttatggctagggcttcacacgtcatacaatggtcggtacagagggttgccaagccgcgaggtggagctaatctcataaaaccgatcgtagtccggattggagtctgcaactcgactccatgaagtcggaatcgctagtaatcgcggatcagcatgtcgcggtgaatacgttcccgggccttgtacacaccgcccgtcacaccatgggaatgggtttcaccagaagtaggtaggctaaccttcgggaggccgcttaccacggtgggattcatgactggggtgaagtcgtaacaaggtagccgtaggggaacctgcggctggatcacctcctttcaag

SEQ ID NO: 4399 - DNA, 1278 bp, Isobaculum melis
  ref <308>: DATABASE ACCESSION NUMBER: NCBI ACCESSION: NZ_FOHA01000041.1
  ref <309>: DATABASE ENTRY DATE: 2019-04-01
  ref <313>: RELEVANT RESIDUES IN SEQ ID NO: (1)..(1278)
tacttttatgagagtttgatcctggctcaggacgaacgctggcggcgtgcctaatacatgcaagtcgaacgcttcttttctcccgaatgcttgcattcaattgaaaagaggagtggcggacgggtgagtaacacgtgggtaacctgcccataagagggggataacagtcggaaacgattgctaataccgcatatacgagaaaccgcatggtttctttgtaaaaggtggctttcatgctaccacttatggatggacccgcggcgtattagctagttggtgaggtaatggctcaccaaggcaatgatacgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagagaagaacaagtaggagagtaactgctcctgccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccctattattagttgccatcatttagttgggcactctaatgagactgccggtgacaaaccggaggaaggtggggatgacgtcaaatcatcatgccccttatgacctgggctacacacgtgctacaatggatggtacaacgagt

SEQ ID NO: 4400 - DNA, 1526 bp, Isoptericola dokdonensis
tttacggagagtttgatcctggctcaggacgaacgctggcggcgtgcttaacacatgcaagtcgaacggtgaagcccagcttgctgggtggatcagtggcgaacgggtgagtaacacgtgagcaacctgccctccacttcgggataagccttggaaacggggtctaataccggatatgagtgcctgctgcatggtgggtgctggaaagtttttcggtgggggatgggctcgcggcctatcagcttgttggtggggtaatggcctaccaaggcgtcgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtttgtcgcgtctggtgtgaaaacctcaggctcaacctggggcgtgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacaggattagataccctggtagtccatgccgtaaacgttgggcactaggtgtggggctcattccacgagttccgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccggaaacactcagagatgggtgccccgcaaggtcggtgcacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggcggggatgacgtcaaatcatcatgccccttatgtcttgggcttcacgcatgctacaatggccggtacagagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagcccatggcccaaccctttgggggggagtggtcgaaggtgggaccggcgattgggactaagtcgtaacaaggtagccgtaccggaaggtgcggctggatcacctcctttctaagga

SEQ ID NO: 4401 - DNA, 1533 bp, Isoptericola sp. CG 20 1183
  ref <308>: DATABASE ACCESSION NUMBER: NCBI ACCESSION: NZ_PVTW01000023.1
  ref <309>: DATABASE ENTRY DATE: 2019-04-01
  ref <313>: RELEVANT RESIDUES IN SEQ ID NO: (1)..(1533)
tttacggagagtttgatcctggctcaggacgaacgctggcggcgtgcttaacacatgcaagtcgaacggtgaagcccagcttgctgggtggatcagtggcgaacgggtgagtaacacgtgagcaacctgccctccacttcgggataagccttggaaacggggtctaataccggatatgagcattcaccgcatggtgggtgttggaaagtttttcggtgggggatgggctcgcggcctatcagcttgttggtggggtgatggcctaccaaggcgtcgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaaggccttcgggtggacggtacctgcagaagaagcgccggctaactacgtgccagcagccgcggtaatacgtagggcgcaagcgttgtccggaattattgggcgtaaagagctcgtaggcggtttgtcgcgtctggtgtgaaatcccgaggctcaacctcgggcttgcatcgggtacgggcagactagagtactgtaggggagactggaattcctggtgtagcggtggaatgcgcagatatcaggaggaacaccgatggcgaaggcaggtctctgggcagttactgacgctgaggagcgaaagcatggggagcgaacaggattagataccctggtagtccatgccgtaaacgttgggcactaggtgtggggctcattccacgagttccgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccggacgctgccagagatggtggttccgcaaggtcggtgcacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggcggggatgacgtcaaatcatcatgccccttatgtcttgggcttcacgcatgctacaatggccggtacagagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagctcatggcccaaccggttttccggggggagtggtcgaaggtgggactggcgattgggactaagtcgtaacaaggtagccgtaccggaaggtgcggctggatcacctcctttctaagga

SEQ ID NO: 4402 - DNA, 1490 bp, Isosphaeraceae bacterium GM2012
  ref <308>: DATABASE ACCESSION NUMBER: NCBI ACCESSION: NZ_RYZH01000109.1
  ref <309>: DATABASE ENTRY DATE: 2019-04-01
  ref <313>: RELEVANT RESIDUES IN SEQ ID NO: (1)..(1490)
ttggcggcgtggattaggcatgcaagtcggacgccccttgggggcgtggcgaaagggtgagtaaggcgacggcaaccaaccccgcggagggggacagccacgggaaactgtgggtaatcccccatgacgccgggccgggacatcccggccgggccaaaggtgcgactccgccgcgggacgggccgtcgtggtatcaggtagttggtggggtaacggcccaccaagcctctgacgcctagcgggcgtgcgagcgtggcccgccacactgggactgagacactgcccagacacctacgggtggctgcagtcgagaatcttcggcaatggtcgacagactgaccgagcgacgccgcgtggaggacgaaggccttcgggttgtaaactcctgtcgagggggaacaaggggccgtgcagagcggtccttgagtgatccctggaggaagcacgggctaagttcgtgccagcagccgcggtaagacgaaccgtgcgaacgttattcggaatcactgggcttaaagcgcgtgtaggcggatcgccgcgtcggtcgctgaaagcccccggctcaaccgggggaccggcgccgatacgggtgatctggaggggcgtagggggagctggaactcacggtggagcggtgaaatgcgttgagatcgtgaggaacgcccgcggcgaaagcgagctcctggacgcctactgacgctgagacgcgaaagccaggggagcgaacgggattagataccccggtagtcctggccgtaaaccatgggcactgggtagggggctcgccgatgggccccctgccgcagcgaaagcgtgaagtgccccgcctggggagtatggccgcaaggctgaaactcaaaggaattgacgggggctcacacaagcggtggagcatgtggcttaattcgaggctacgcgaagaaccttatcccgggcttgacatgcacggattagcctcctgaaagggaggtgacgccttcgggtggaacgtgcacaggtgctgcatggctgtcgtcagctcgtgccgtgaggtgttgggttaagtcccgtaacgagcgaaacccctgcgaccagttgccagcattgagttggggactctggtcggaccgccggcgtcaagccggaggaaggcggggacgacgtcaagtcatcatggcccttatgcccggggctgcacacgtgctacaatgggccggacagagcgtcgccactgcgcaagcaggagccaatcgcagaaaccggcccccagttcggattgcgggctgcaacccgcccgcatgaagccggaatcgctagtaatcgcggatcagcagtgccgcggtgaatgggttcctgagccttgtacacaccgcccgtcaagccaccaaagcggggggcacccgaagtcgctgcgcccgcaagggcaggcgccgaaggtgaaacccgtgatggggactaagtcgtaacaaggtaaccgtaggggaacctgcggttggatcacctcctttcta

SEQ ID NO: 4403 - DNA, 1547 bp, Izhakiella australiensis
  ref <308>: DATABASE ACCESSION NUMBER: NCBI ACCESSION: NZ_MRUL01000053.1
  ref <309>: DATABASE ENTRY DATE: 2019-04-01
  ref <313>: RELEVANT RESIDUES IN SEQ ID NO: (1)..(1547)
tttaattgaagagtttgatcatggctcagattgaacgctggcggcaggcctaacacatgcaagtcgaacggcagcgggggagagcttgctctcccgccggcgagtggcggacgggtgagtaatgtctggggatctgcccgatggagggggataaccactggaaacggtggctaataccgcataacgtcgcaagaccaaagtgggggaccttcgggcctcacaccatcggatgaacccagatgggattagctagtaggtggggtaaaggctcacctaggcgacgatccctagctggtctgagaggatgaccagccacactggaactgagacacggtccagactcctacgggaggcagcagtggggaatattgcacaatgggggaaaccctgatgcagccatgccgcgtgtatgaagaaggccttcgggttgtaaagtactttcagtcaggaggaagggcgagtggttaataaccgcccgcattgacgttactgacagaagaagcaccggctaactccgtgccagcagccgcggtaatacggagggtgcaagcgttaatcggaattactgggcgtaaagcgcacgcaggcggtctgttaagtcagatgtgaaatccccgggctcaacccgggaactgcatttgaaactggcaggcttgagtctcgtagaggggggtggaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgtgagcttgactcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaaggtctcagagatgagaccgtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaacccgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 4404 - DNA, 1034 bp, Izhakiella capsodis
  ref <308>: DATABASE ACCESSION NUMBER: NCBI ACCESSION: NZ_FOVC01000030.1
  ref <309>: DATABASE ENTRY DATE: 2019-04-01
  ref <313>: RELEVANT RESIDUES IN SEQ ID NO: (1)..(1034)
ttaaattgaagagtttgatcatggctcagattgaacgctggcggcaggcctaacacatgcaagtcgaacggcagcgggggagagcttgctctcctgccggcgagtggcggacgggtgagtaatgtctggggatctgcccgatggagggggataaccactggaaacggtggctaataccgcatgaagtcgcaagaccaaagtgggggaccttcgggcctcacgccataggatgaacccagatgggattagctggtaggtggggtaaaggcccacctaggcgacgatccctagctggtctgagaggatgaccagccacactggaactgagacacggtccagactcctacgggaggcagcagtggggaatattgcacaatggggggaaccctgatgcagccatgccgcgtgtatgaagaaggccttagggttgtaaagtactttcagtcaggaggaagggtgagcagtgaatagctgtttgcattgacgttactgacagaagaagcaccggctaactccgtgccagcagccgcggtaatacggagggtgcaagcgttaatcggaattactgggcgtaaagcgcacgcaggcggtctgttaagtcagatgtgaaatccccgggcttaacccgggaactgcatttgaaactggcaggctggagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaaggtcccagagatggggctgtgccttcg

SEQ ID NO: 4405 - DNA, 1530 bp, Janibacter hoylei
  ref <308>: DATABASE ACCESSION NUMBER: NCBI ACCESSION: NZ_PIPF01000018.1
  ref <309>: DATABASE ENTRY DATE: 2019-04-01
  ref <313>: RELEVANT RESIDUES IN SEQ ID NO: (1)..(1530)
tcaacggagagtttgatcctggctcaggacgaacgctggcggcgtgcttaacacatgcaagtcgaacggtgatgctccagcttgctggagtggatcagtggcgaacgggtgagtaacacgtgagcaacctgccccagactctggaataagcgctggaaacggcgtctaatactggatacgaaactggcccgcatgggcatggtttggaaagtttttcggtttgggatgggctcgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcaccggctaactacgtgccagcagccgcggtaatacgtagggtgcgagcgttgtccggaattattgggcgtaaagagcttgtaggcggtttgtcgcgtctgctgtgaaaatccggggctcaaccccggacttgcagtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcgaacaggattagataccctggtagtccatgccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatatcggaaacatccagagatgggtgccccttttaggtcggtatacaggtggtgcatggttgtcgtcagctcgtgtcgtgagatgttgggttaagtcccgcaacgagcgcaaccctcgttctatgttgccagcacgttatggtggggactcatggaagactgccggggtcaactcggaggaaggtggggatgacgtcaaatcatcatgccccttatgtcttgggcttcacgcatgctacaatggccggtacaaagggctgcgaaaccgtaaggtggagcgaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggagccgtcgaaggtgggactggcgattgggactaagtcgtaacaaggtagccgtaccggaaggtgcggctggatcacctcctttctaagga

SEQ ID NO: 4406 - DNA, 1531 bp, Janibacter melonis
  ref <308>: DATABASE ACCESSION NUMBER: NCBI ACCESSION: NZ_RIBU01000023.1
  ref <309>: DATABASE ENTRY DATE: 2019-04-01
  ref <313>: RELEVANT RESIDUES IN SEQ ID NO: (1)..(1531)
tcaacggagagtttgatcctggctcaggacgaacgctggcggcgtgcttaacacatgcaagtcgaacggtgaaccttggagcttgcttcgaggggatcagtggcgaacgggtgagtaacacgtgagtaacctgccccggactctggaataagcgctggaaacggcgtctaataccggatacgagacgcaaccgcatggttagtgtctggaaagtttttcggtctgggatggactcgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcaccggctaactacgtgccagcagccgcggtaatacgtagggtgcgagcgttgtccggaattattgggcgtaaagagcttgtaggcggtttgtcgcgtctgctgtgaaaatccggggctcaaccccggacttgcagtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcgaacaggattagataccctggtagtccatgccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatataccggaaacacccagagatgggtgccccttttggtcggtatacaggtggtgcatggttgtcgtcagctcgtgtcgtgagatgttgggttaagtcccgcaacgagcgcaaccctcgttctatgttgccagcacgtaaaggtggggactcataggagactgccggggtcaactcggaggaaggtggggatgacgtcaaatcatcatgccccttatgtcttgggcttcacgcatgctacaatggccggtacaaagggctgcgataccgcaaggtggagcgaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggtgattgggactaagtcgtaacaaggtagccgtaccggaaggtgcggctggatcacctcctttctaagga

SEQ ID NO: 4407 - DNA, 1467 bp, Jannaschia aquimarina
  ref <308>: DATABASE ACCESSION NUMBER: NCBI ACCESSION: NZ_FZPF01000008.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcttaatacatgcaagtcgagcgcaccttcgggtgagcggcggacgggtgagtaacgcgtgggaatatgcccttcactgcggaatagcctcgggaaactgagagtaataccgcatacgcccttcgggggaaagatttatcggtgaaggattagcccgcgtctgattagatagttggtggggtaacggcctaccaagtcgacgatcagtagctggtttgagaggatgatcagccacactgggactgagacacggcccagactcctacgggaggcagcagtagggaatcttcggcaatgggcgaaagcctgaccgagccatgccgcgtgtgtgatgacggccctagggttgtaaagcactttcgccagggatgataatgacagtacctggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcccttgatactggtagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagggggcttgccctttggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggttaccggagacggtttccttcagttcggctggatcagtgacaggtgctgcatggctgtcgtcagctcgtgtcgtgagatgttcggttaagtccggcaacgagcgcaacccacacccttagttgccagcattcagttgggcactctaggggaactgtccgtgataagcgggaggaaggtgtggatgacgtcaagtcctcatggcccttacgggttgggctacacacgtgctacaatggcagtgacaatgggttaatcccaaaaaactgtctcagttcggattgtcctctgcaactcgagggcatgaagtcggaatcgctagtaatcgcgtaacagcatgacgcggtgaatacgttcccgggccttgtacacaccgcccgtcacaccatgggagttgggtccacccgaaggccgtgcgccaaccgtaaggaggcagcggaccacggtgagctcagcgactggggtgaagtcgtaacaaggtagccgtaggggaacctgcggctggatcacctcctttctaa

SEQ ID NO: 4408 - DNA, 1471 bp, Jannaschia donghaensis
  ref <308>: DATABASE ACCESSION NUMBER: NCBI ACCESSION: NZ_CXSU01000003.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcacgcctaacacatgcaagtcgagcgcaccttcgggtgagcggcggacgggttagtaacgcgtgggaacgtacccttttctacggaatagcctcgggaaactgagagtaataccgtatacgcccttttggggaaagatttatcggtgaaggatcggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagcgatgccgcgtgagtgatgaaggtcttaggatcgtaaagctctttcgccagggatgataatgacagtacctggtaaagaaaccccggctaactccgtgccagcagccgcggtaatacggagggggttagcgttgttcggaattactgggcgtaaagcgcacgtaggcggactattaagtcagaggtgaaatcccagggctcaaccctggaacggcctttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcttgcaactcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgcggttaccagagatggtttccttcagttcggctggatatcacacaggtgctgcatggctgtcgtcagctcgtgtcgtgagatgttcggttaagtccggcaacgagcgcaacccacatccttagttgccagcattcagttgggcactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtccacccgaaggccgtgcgccaacctcgcaagagggggcagcggaccacggtgagctcagcgactggggtgaagtcgtaacaaggtagccgtaggggaacctgcggctggatcacctcctttctaa

SEQ ID NO: 4409 - DNA, 1471 bp, Jannaschia faecimaris
  ref <308>: DATABASE ACCESSION NUMBER: NCBI ACCESSION: NZ_FNPX01000042.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcacgcctaacacatgcaagtcgagcgcaccttcgggtgagcggcggacgggttagtaacgcgtgggaacatacccttttctacggaatagcctcgggaaactgagagtaataccgtatacgccctttgggggaaagatttatcggtgaaggattggcccgcgtctgattagatagttggtggggtaatggcctaccaagtctacgatcagtagctggtttgagaggatgatcagcaacactgggactgagacacggcccagactcctacgggaggcagcagtggggaatcttagacaatgggcgcaagcctgatctagcgatgccgcgtgagtgatgaaggtcttaggatcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattattaagttagaggtgaaatcccagggctcaaccctggaactgcctttaatactggtaatctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcaggttgcttgcaacttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatagaaatcgcggttaccagagatggtttccttcagttcggctggatttcatacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtccacccgaaggccgtgcgccaacctgcttgcagggggcagcggaccacggtgagctcagcgactggggtgaagtcgtaacaaggtagccgtaggggaacctgcggctggatcacctcctttctaa

SEQ ID NO: 4410 - DNA, 1469 bp, Jannaschia pohangensis
  ref <308>: DATABASE ACCESSION NUMBER: NCBI ACCESSION: NZ_FORA01000006.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcacgcctaacacatgcaagtcgagcgcaccttcgggtgagcggcggacgggttagtaacgcgtgggaacgtacccttcactaaggaatagcctcgggaaactgagagtaataccttatacgcccttcgggggaaagatttatcggtgaaggatcggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagcgatgccgcgtgagtgatgaaggtcttaggatcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattattaagttaggggtgaaatcccagggctcaaccctggaactgcctctaatactggtaatctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcaggttgcttgcaacttggtgacacacctaacggattaagcattccgcctggggagtacggtcgcaagattaaaactcaaaggaattgacggggggccgcacaagcggtggagcatgtggtttaattcgaagcaacgcgcagaaccttaccaacccttgacatcctgatcgcggtttagagagatctattccttcagttcggctggatcagtgacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggcatctacagtgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtccacccgaaggccgtgcgccaaccagcaatggaggcagcggaccacggtgagctcagcgactggggtgaagtcgtaacaaggtagccgtaggggaacctgcggctggatcacctcctttctaa

SEQ ID NO: 4411 - DNA, 1470 bp, Jannaschia rubra
  ref <308>: DATABASE ACCESSION NUMBER: NCBI ACCESSION: NZ_FOOS01000001.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcacgcctaacacatgcaagtcgagcgcaccttcgggtgagcggcggacgggttagtaacgcgtgggaacatacccttctctacggaatagtctcgggaaactgagggtaataccgtatacgccctttgggggaaagatttatcggagaaggattggcccgcgtctgattagatagttggtggggtaatggcctaccaagtcgacgatcagtagctggtttgagaggatgatcagcaacactgggactgagacacggcccagactcctacgggaggcagcagtggggaatcttagacaatgggcgaaagcctgatctagcgatgccgcgtgagtgatgaaggtcttaggatcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactattaagtcgggggtgaaatcccggggctcaaccccggaactgcctccgatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcaggttgcttgcaacttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttagtggagacactttccttcagttcggctggatcagtgacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtccacccgaaggccgtgcgccaacctgcttgcaggaggcagcggaccacggtgagctcagcgactggggtgaagtcgtaacaaggtagccgtaggggaacctgcggctggatcacctcctttcta

SEQ ID NO: 4412 - DNA, 1467 bp, Jannaschia seohaensis
  ref <308>: DATABASE ACCESSION NUMBER: NCBI ACCESSION: NZ_UETC01000030.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgcgccttcgggtgagcggcggacgggttagtaacgcgtgggaatatgcccttcactacggaatagccccgggaaactgggagtaatgccgtatacgccctttgggggaaagatttatcggtgaaggattagcccgcgtctgattagatagttggtggggtaacggcctaccaagtcgacgatcagtagctggtttgagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgcgcgtaggcggattattaagtcgggggtgaaatcccggggctcaaccccggaactgcctccgatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggacgcttgcgtttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctcgtcgcggtttagagagatctattccttcagttcggctggacgagtgacaggtgctgcatggctgtcgtcagctcgtgtcgtgagatgttcggttaagtccggcaacgagcgcaacccacacccttagttgccatcattcagttgggcactctaggggaactgcccgtgataagcgggaggaaggtgtggatgacgtcaagtcctcatggcccttacgggttgggctacacacgtgctacaatggcatctacaacgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtccacccgaaggccgtgcgccaaccgtaaggaggcagcggaccacggtgagctcagcgactggggtgaagtcgtaacaaggtagccgtaggggaacctgcggctggatcacctcctttctaa

SEQ ID NO: 4413 - DNA, 1467 bp, Jannaschia seosinensis
  ref <308>: DATABASE ACCESSION NUMBER: NCBI ACCESSION: NZ_CYPR01000094.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcacgcctaacacatgcaagtcgagcgcaccttcgggtgagcggcggacgggttagtaacgcgtgggaacgtacccttcactgcggaatagcctcgggaaactgagagtaataccgcatacgcccttcgggggaaagatttatcggtgaaggatcggcccgcgtctgattagatagttggtggggtaatggcctaccaagtcgacgatcagtagctggtttgagaggatgatcagcaacactgggactgagacacggcccagactcctacgggaggcagcagtggggaatcttagacaatgggcgcaagcctgatctagcgatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagggggcttgccctttggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggttacgagagatcgtttccttcagttcggctggatcagtgacaggtgctgcatggctgtcgtcagctcgtgtcgtgagatgttcggttaagtccggcaacgagcgcaacccacacccttagttgccagcattcagttgggcactctaggggaactgtccgtgataagcgggaggaaggtgtggatgacgtcaagtcctcatggcccttacgggttgggctacacacgtgctacaatggcatctacagtgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtccacccgaaggccgtgcgccaaccgtaagggggcagcggaccacggtgagctcagcgactggggtgaagtcgtaacaaggtagccgtaggggaacctgcggctggatcacctcctttctaa

SEQ ID NO: 4414 - DNA, 1468 bp, Jannaschia sp. 12N15
  ref <308>: DATABASE ACCESSION NUMBER: NCBI ACCESSION: NZ_QPLJ01000057.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcacgcctaacacatgcaagtcgagcgcaccttcgggtgagcggcggacgggttagtaacgcgtgggaacgtacccttttctgcggaatagccttgggaaaccgagagtaataccgcatacgccctttgggggaaagatttatcggtgaaggatcggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagcgatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgcgcgtaggcggatatttaagtcgggggtgaaatcccggggctcaaccccggaactgcctccgatactgggtatctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggacgcttgcgtttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatacctgtcgcgggctagggagacctagtccttcagttcggctggacaggatacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggcatctacagtgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtccacccgaaggccgtgcgccaacccgcaaggggggcagcggaccacggtgagctcagcgactggggtgaagtcgtaacaaggtagccgtaggggaacctgcggctggatcacctcctttcta

SEQ ID NO: 4415 - DNA, 1473 bp, Jannaschia sp. CCS1
  ref <308>: DATABASE ACCESSION NUMBER: NCBI ACCESSION: NC_007802.1
  ref <309>: DATABASE ENTRY DATE: 2019-04-01
  ref <313>: RELEVANT RESIDUES IN SEQ ID NO: (1)..(1473)
tcaacttgagagtttgatcctggctcagaacgaacgctggcggcacgcctaacacatgcaagtcgagcgctaccttcgggtggagcggcggacgggttagtaacgcgtgggaacatacccttttctgcggaatagcctttggaaacgaagagtaataccgcatacgcccctcgggggaaagatttatcggtgaaggattggcccgcgtaagattagatagttggtggggtaacggcctaccaagtcgacgatctttagctggtttgagaggatgatcagcaacactgggactgagacacggcccagactcctacgggaggcagcagtggggaatcttagacaatgggcgcaagcctgatctagcgatgccgcgtgagtgatgaaggtcttaggatcgtaaagctctttcgccagggatgataatgacagtacctggtaaagaaaccccggctaactccgtgccagcagccgcggtaatacggagggggttagcgttgttcggaattactgggcgtaaagcgcacgtaggcggattattaagtgaggggtgaaatcccagggctcaaccctggaactgcctctcatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcagggggcttgccctttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgcggatcgtagagatactttccttcagttcggctggatatcacacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggcatctacagtgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacggccgtgcgctaaccttcgggaggcagcggaccacggtaggatcagcgactggggtgaagtcgtaacaaggtagccgtaggggaacctgcggctggatcacctcctttctaagg

SEQ ID NO: 4416 - DNA, 1469 bp, Jannaschia sp. EhC01
  ref <308>: DATABASE ACCESSION NUMBER: NCBI ACCESSION: NZ_LXYJ01000030.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcacgcctaacacatgcaagtcgagcgctaccttcgggtggagcggcggacgggttagtaacgcgtgggaacatacccttttctacggaatagcctcgggaaactgagagtaataccgtatacgcccctcgggggaaagatttatcggtgaaggattggcccgcgtaagattagatagttggtggggtaatggcctaccaagtcgacgatctttagctggtttgagaggatgatcagcaacactgggactgagacacggcccagactcctacgggaggcagcagtggggaatcttagacaatgggcgcaagcctgatctagcgatgccgcgtgagtgatgaaggtcttaggatcgtaaagctctttcgccagagatgataatgacagtatctggtaaagaaaccccggctaactccgtgccagcagccgcggtaatgcggagggggttagcgttgttcggaattactgggcgtaaagcgcacgtaggcggattattaagtgaggggtgaaatcccggggctcaaccccggaactgcctctcatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgtgtatcgagatttcccgagagggatttcgtcagttcggctggatacaacacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggcatctacagtgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacggccgtgcgctaaccttcgggaggcagcggaccacggtaggatcagcgactggggtgaagtcgtaacaaggtagccgtaggggaacctgcggctggatcacctcctttcta

SEQ ID NO: 4417 - DNA, 1540 bp, Janthinobacterium agaricidamnosum
  ref <308>: DATABASE ACCESSION NUMBER: NCBI ACCESSION: NZ_CP033019.1
  ref <309>: DATABASE ENTRY DATE: 2019-04-01
  ref <313>: RELEVANT RESIDUES IN SEQ ID NO: (1)..(1540)
agattaaactgaagagtttgatcctggctcagattgaacgctggcggcatgccttacacatgcaagtcgaacggcagcacggagcttgctctggtggcgagtggcgaacgggtgagtaatatatcggaacgtaccctggagtgggggataacgtagcgaaagttacgctaataccgcatacgatctacggatgaaagtgggggatcgcaagacctcatgctcgtggagcggccgatatctgattagctagttggtagggtaaaagcctaccaaggcatcgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtgagagctaatatctcttgctaatgacggtacctgaagaataagcaccggctaactacgtgccagcagccgcggtaatacgtagggtgcaagcgttaatcggaattactgggcgtaaagcgtgcgcaggcggttttgtaagtctgatgtgaaatccccgggctcaacctgggaattgcattggagactgcaaggctagaatctggcagaggggggtagaattccacgtgtagcagtgaaatgcgtagatatgtggaggaacaccgatggcgaaggcagccccctgggtcaagattgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggctggaatccccgagagattggggagtgctcgaaagagagccagtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagcgccgccaacccgcgagggggagctaatcgcagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgtaaggagggcgcttaccacggtaggattcgtgactggggtgaagtcgtaacaaggtagccgtatcggaaggtgcggctggatcacctcctttctag

SEQ ID NO: 4418 - DNA, 1540 bp, Janthinobacterium lividum
  ref <308>: DATABASE ACCESSION NUMBER: NCBI ACCESSION: NZ_UGJG01000004.1
  ref <309>: DATABASE ENTRY DATE: 2019-04-01
  ref <313>: RELEVANT RESIDUES IN SEQ ID NO: (1)..(1540)
agattaaactgaagagtttgatcctggctcagattgaacgctggcggcatgccttacacatgcaagtcgaacggcagcacggagcttgctctggtggcgagtggcgaacgggtgagtaatatatcggaacgtaccctggagtgggggataacgtagcgaaagttacgctaataccgcatacgatctaaggatgaaagtgggggatcgcaagacctcatgctcgtggagcggccgatatctgattagctagttggtagggtaaaagcctaccaaggcatcgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtgagagctaatatctcttgctaatgacggtacctgaagaataagcaccggctaactacgtgccagcagccgcggtaatacgtagggtgcaagcgttaatcggaattactgggcgtaaagcgtgcgcaggcggttttgtaagtctgatgtgaaatccccgggctcaacctgggaattgcattggagactgcaaggctagaatctggcagaggggggtagaattccacgtgtagcagtgaaatgcgtagatatgtggaggaacaccgatggcgaaggcagccccctgggtcaagattgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggctggaatccccgagagatcggggagtgctcgaaagagaaccagtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagcgccgccaacccgcgagggggagctaatcgcagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttctag

SEQ ID NO: 4419 - DNA, 1540 bp, Janthinobacterium sp. 17J80-10
  ref <308>: DATABASE ACCESSION NUMBER: NCBI ACCESSION: NZ_CP035311.1
  ref <309>: DATABASE ENTRY DATE: 2019-04-01
  ref <313>: RELEVANT RESIDUES IN SEQ ID NO: (1)..(1540)
agattaaactgaagagtttgatcctggctcagattgaacgctggcggcatgccttacacatgcaagtcgaacggcagcacgggggcaaccctggtggcgagtggcgaacgggtgagtaatatatcggaacgtgccctggagtgggggataacgtagcgaaagttacgctaataccgcatacgatctaaggatgaaagtgggggatcgcaagacctcatgctcgtggagcggccgatatctgattagctagttggtagggtaaaagcctaccaaggcgacgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggtgcgggctaatatcctgtgctaatgacggtacctgaagaataagcaccggctaactacgtgccagcagccgcggtaatacgtagggtgcaagcgttaatcggaattactgggcgtaaagcgtgcgcaggcggttgtgtaagtttgtcgtgaaatccccgggctcaacctgggaattgcgatgaagactgcacggctagagtgtgtcagaggggggtagaattccacgtgtagcagtgaaatgcgtagatatgtggaggaacaccgatggcgaaggcagccccctgggataacactgacgctcatgcacgaaagcgtggggagcaaacaggattagataccctggtagtccacgccctaaacgatgtcaactagttgtcgggtcttaattgacttggtaacgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaaccctgctgagaggcgggggtgctcgaaagagaaccgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctag

SEQ ID NO: 4420 - DNA, 1540 bp, Janthinobacterium sp. 78
  ref <308>: DATABASE ACCESSION NUMBER: NCBI ACCESSION: NZ_QENT01000001.1
  ref <309>: DATABASE ENTRY DATE: 2019-04-01
  ref <313>: RELEVANT RESIDUES IN SEQ ID NO: (1)..(1540)
agattaaactgaagagtttgatcctggctcagattgaacgctggcggcatgccttacacatgcaagtcgaacggcagcacggagcttgctctggtggcgagtggcgaacgggtgagtaatatatcggaacgtaccctagagtgggggataacgtagcgaaagttacgctaataccgcatacgatctaaggatgaaagtgggggatcgcaagacctcatgctcgtggagcggccgatatctgattagctagttggtagggtaaaagcctaccaaggcatcgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtgagagctaatatctcttgctaatgacggtacctgaagaataagcaccggctaactacgtgccagcagccgcggtaatacgtagggtgcaagcgttaatcggaattactgggcgtaaagcgtgcgcaggcggttttgtaagtctgatgtgaaatccccgggctcaacctgggaattgcattggagactgcaaggctagaatctggcagaggggggtagaattccacgtgtagcagtgaaatgcgtagatatgtggaggaacaccgatggcgaaggcagccccctgggtcaagattgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggctggaatccttgagagatcagggagtgctcgaaagagaaccagtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagcgccgccaacccgcgagggggagctaatcgcagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgtaaggagggcgcttaccacggtaggattcgtgactggggtgaagtcgtaacaaggtagccgtatcggaaggtgcggctggatcacctcctttctag

SEQ ID NO: 4421 - DNA, 1539 bp, Janthinobacterium sp. CG23 2
  ref <308>: DATABASE ACCESSION NUMBER: NCBI ACCESSION: NZ_CYSS01000003.1
  ref <309>: DATABASE ENTRY DATE: 2019-04-01
  ref <313>: RELEVANT RESIDUES IN SEQ ID NO: (1)..(1539)
agattgaactgaagagtttgatcctggctcagattgaacgctggcggcatgccttacacatgcaagtcgaacggcagcgcggggcaacctggcggcgagtggcgaacgggtgagtaatatatcggaacgtaccctggagtgggggataacgtagcgaaagttacgctaataccgcatacgatctaaggatgaaagtgggggattcgcaagaacctcatgctcctggagcggccgatatctgattagctagttggtggggtaaaggcctaccaaggcatcgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtgagggctaatatcccttgctaatgacggtacctgaagaataagcaccggctaactacgtgccagcagccgcggtaatacgtagggtgcaagcgttaatcggaattactgggcgtaaagcgtgcgcaggcggttttgtaagtctgtcgtgaaatccccgggctcaacctgggaattgcgatggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaagccacgagagatcgaggtgtgctcgaaagagaaccgtaacacaggtgctgcatggctgtcgtcagctcgtgtcgtgagatgttgggttaagtcccgcaacgagcgcaacccttgtcattagttgctacgaaagagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtaggtagcttaaccgcaaggggggcgcttaccacggtaggattcgtgactggggtgaagtcgtaacaaggtagccgtatcggaaggtgcggctggatcacctcctttcta

SEQ ID NO: 4422 - DNA, 1543 bp, Janthinobacterium sp. CG3
  ref <308>: DATABASE ACCESSION NUMBER: NCBI ACCESSION: NZ_KB467824.1
  ref <309>: DATABASE ENTRY DATE: 2019-04-01
  ref <313>: RELEVANT RESIDUES IN SEQ ID NO: (1)..(1543)
agagattaaactgaagagtttgatcctggctcagattgaacgctggcggcatgccttacacatgcaagtcgaacggcagcacggagcttgctctggtggcgagtggcgaacgggtgagtaatatatcggaacgtaccctagagtgggggataacgtagcgaaagttacgctaataccgcatacgatctaaggatgaaagtgggggattcgcaagaacctcatgctcgtggagcggccgatatctgattagctagttggtagggtaaaagcctaccaaggcatcgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtggtttctaatacagatcactaatgacggtacctgaagaataagcaccggctaactacgtgccagcagccgcggtaatacgtagggtgcaagcgttaatcggaattactgggcgtaaagcgtgcgcaggcggttttgtaagtctgtcgtgaaatccccgggctcaacctgggaattgcgatggagactgcaaggctagagtttggcagaggggggtagaattccacgtgtagcagtgaaatgcgtagatatgtggaggaacaccgatggcgaaggcagccccctgggtcaagactgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggctggaacccttgagagatcagggggtgcccgaaagggaaccagtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagcgccgccaacccgcgagggggagctaatcgcagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttcta

SEQ ID NO: 4423 - DNA, 1561 bp, Jeotgalibaca dankookensis
  ref <308>: DATABASE ACCESSION NUMBER: NCBI ACCESSION: NZ_CP019728.1
  ref <309>: DATABASE ENTRY DATE: 2019-04-01
  ref <313>: RELEVANT RESIDUES IN SEQ ID NO: (1)..(1561)
ttaatgagagtttgatcctggctcaggacgaacgctggcggcgtgcctaatacatgcaagtcgaacgaacggaagaagagcttgctctttggaagtgagtggcggacgggtgagtaacacgtgggtaacctgcccttcagtgggggataacatccggaaacgggtgctaataccgcataggttctctttccacatggaaagagaaggaaagacggcctttgtgctgtcgctgagggatggacccgcggcgtattagttagttggtggggtaaaggcctaccaagaccatgatacgtagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgtcggagaagaacacgtaagcgagtaactgcgcttaccatgacggtacccgaccagaaagccacggctaactacgtgccagcagccgcggtaatacgtaggtggcaagcgttgtccggatttattgggcgtaaagcgagcgcaggcggttctttaagtctgatgtgaaagcccacggctcaaccgtggaaggtcattggaaactggggaacttgaatgcagaagaggagagtggaattccatgtgtagcggtgaaatgcgtagatatatggaggaacaccagtggcgaaggcgactctctggtctgttattgacgctgaggctcgaaagcgtggggagcaaacaggattagataccctggtagtccacgccgtaaacgatgagtgctaagtgttggagggcttccacccttcagtgctgcagttaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccttgacacgcctagagataggccgttcccttcggggacaaggtgacaggtggtgcatggttgtcgtcagctcgtgtcgtgagatgttgggttaagtcccgtaacgagcgcaacccttattgttagttgccagcatttagttgggcactctaatgagactgccggtgataaaccggaggaaggtggggatgacgtcaaatcatcatgccccttatgacctgggctacacacgtgctacaatggatggtacaacgagccgctaacccgcgagggcatgcgaatctcttaaagccattctcagttcggattgcaggctgcaactcgcctgcatgaagccggaatcgctagtaatcgcggatcagaacgccgcggtgaatacgttcccgggtcttgtacacaccgcccgtcacaccacgagagtttgtaacacccgaagtcggtggggtaacccttaggggaaccagccgcctaaggtgggacggatgattggggtgaagtcgtaacaaggtagccgtatcggaaggtgcggctggatcacctcctttctaaggaa

SEQ ID NO: 4424 - DNA, 1561 bp, Jeotgalibaca sp. H21T32
  ref <308>: DATABASE ACCESSION NUMBER: NCBI ACCESSION: NZ_CP034465.1
  ref <309>: DATABASE ENTRY DATE: 2019-04-01
  ref <313>: RELEVANT RESIDUES IN SEQ ID NO: (1)..(1561)
catgagagtttgatcctggctcaggacgaacgctggcggcgtgcctaatacatgcaagtcgtacgaaccgattaaggagcttgctccttatgacgttagtggcgaacgggtgagtaacacgtgggtaacctgcccttaagcgggggataacatccggaaacgggtgctaataccgcatagtttccctctccacatggagggggaaggaaagacggcctttgtgctgtcgcttagggatggacccgcggcgtattagttagttggtagggtaacggcctaccaaggcgatgatacgtagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgtcggagaagaacaagcaggaaaggaactgttcctgccttgacggtacccgaccagaaagccacggctaactacgtgccagcagccgcggtaatacgtaggtggcaagcgttgtccggatttattgggcgtaaagcgagcgcaggcggttccttaagtctgatgtgaaagcccacggctcaaccgtggaaggtcattggaaactggggaacttgaatgcagaagaggagagtggaattccatgtgtagcggtgaaatgcgtagatatatggaggaacaccagtggcgaaggcgactctctggtctgtaattgacgctgaggctcgaaagcgtggggagcaaacaggattagataccctggtagtccacgccgtaaacgatgagtgctaagtgttggagggtttccacccttcagtgctgcagttaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccttgccattcccagagatgggaggttcccttcggggacaaggtgacaggtggtgcatggttgtcgtcagctcgtgtcgtgagatgttgggttaagtcccgcaacgagcgcaacccttattgctagttgccagcattcagttgggcactctagtgagactgccggtgacaaaccggaggaaggtggggatgacgtcaaatcatcatgccccttatgacctgggctacacacgtgctacaatggatggtacaacgagcagcgaacccgcgagggcaagcgaatctctgaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtggggtaacccttacgggagccagccgcctaaggtgggatagatgattggggtgaagtcgtaacaaggtagccgtatcggaaggtgcggctggatcacctcctttctaaggaa

SEQ ID NO: 4425 - DNA, 1561 bp, Jeotgalibaca sp. PTS2502
  ref <308>: DATABASE ACCESSION NUMBER: NCBI ACCESSION: NZ_CP019433.1
  ref <309>: DATABASE ENTRY DATE: 2019-04-01
  ref <313>: RELEVANT RESIDUES IN SEQ ID NO: (1)..(1561)
catgagagtttgatcctggctcaggacgaacgctggcggcgtgcctaatacatgcaagtcgtacgaattgattaaggagcttgctccttatgacgttagtggcgaacgggtgagtaacacgtgggtaacctaccttcaagagggggataacatccggaaacgggtgctaataccgcatagtttcagcttccacatggaagccgaaggaaagacggcctttgtgctgtcacttggagatggacccgcggcgcattagttagttggtagggtaacggcctaccaagacgatgatgcgtagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgttggagaagaacaagtaggagagtaactgctcttaccttgacggtacccaaccagaaagccacggctaactacgtgccagcagccgcggtaatacgtaggtggcaagcgttgtccggatttattgggcgtaaagcgagcgcaggcggttccttaagtctgatgtgaaagcccacggctcaaccgtggaaggtcattggaaactggggaacttgaatgcagaagaggagagtggaattccatgtgtagcggtgaaatgcgtagatatatggaggaacaccagtggcgaaggcgactctctggtctgtaattgacgctgaggctcgaaagcgtggggagcaaacaggattagataccctggtagtccacgccgtaaacgatgagtgctaagtgttggagggtttccacccttcagtgctgcagttaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccttgacactcctagagataggacgttcccttcggggacaaggtgacaggtggtgcatggttgtcgtcagctcgtgtcgtgagatgttgggttaagtcccgcaacgagcgcaacccctattgttagttgccagcattcagttgggcactctaataagactgccggtgacaaaccggaggaaggtggggatgacgtcaaatcatcatgccccttatgacctgggctacacacgtgctacaatggatggtacaacgagcagcaaacccgcgagggcaagcgaatctcttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtggggtaacccttatgggagccagccgcctaaggtgggatagatgattggggtgaagtcgtaacaaggtagccgtatcggaaggtgcggctggatcacctcctttctaaggaa

SEQ ID NO: 4426 - DNA, 1557 bp, Jeotgalibacillus alimentarius
  ref <308>: DATABASE ACCESSION NUMBER: NCBI ACCESSION: NZ_JXRQ01000005.1
  ref <309>: DATABASE ENTRY DATE: 2019-04-01
  ref <313>: RELEVANT RESIDUES IN SEQ ID NO: (1)..(1557)
tttacggagagtttgatcctggctcaggacgaacgctggcggcgtgcctaatacatgcaagtcgagcgaacagatgaggagcttgctcctctgacgttagcggcggacgggtgagtaacacgtgggcaacctgccctgcagattgggataactccgggaaaccggggctaataccgaataacagaaagaatctcctgattcttttttgaaaggcggcttttagctgtcactgcaggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgtcagggaagaacaagtaccatagtaactgatggtaccttgacggtacctgaccagaaagccacggctaactacgtgccagcagccgcggtaatacgtaggtggcaagcgttgtccggaattattgggcgtaaagcgcgcgcaggtggttccaaaagtctgatgtgaaagcccccggctcaaccggggagggtcattggaaactggggaacttgagtgcaggagaggaaagtggaattccacgtgtagcggtgaaatgcgtagatatgtggaggaacaccagtggcgaaggcgactttctggcctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccggtgaccgcactggagacagtgttttcccttcggggacaacggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacgatacaaagggctgcgagaccgcgaggtttagccaatcccataaaatcgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttctaa

SEQ ID NO: 4427 - DNA, 1553 bp, Jeotgalibacillus campisalis
  ref <308>: DATABASE ACCESSION NUMBER: NCBI ACCESSION: NZ_JXRR01000019.1
  ref <309>: DATABASE ENTRY DATE: 2019-04-01
  ref <313>: RELEVANT RESIDUES IN SEQ ID NO: (1)..(1553)
tttacggagagtttgatcctggctcaggacgaacgctggcggcgtgcctaatacatgcaagtcgagcgaattttctggagcttgctccagaaagttagcggcggacgggtgagtaacacgtgggcaatctgcccgtaagactgggataactccgggaaaccggggctaataccggataatcctgactctctcctgagagtcggttgaaagatggtttcggctatcacttacggatgagcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacacgtacgagagtaactgctcgtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccccggctcaaccggggagggtcattggaaactggggaacttgagtgcaggagaggaaagtggaattccacgtgtagcggtgaaatgcgtagatatgtggaggaacaccagtggcgaaggcgactttctggcctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccattgcccggtctagagatagacttttcccttcggggacaatggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacgatacaaagggctgcgagaccgcgaggtggagccaatcccataaaatcgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttct

SEQ ID NO: 4428 - DNA, 1557 bp, Jeotgalibacillus malaysiensis
  ref <308>: DATABASE ACCESSION NUMBER: NCBI ACCESSION: NZ_CP009416.1
  ref <309>: DATABASE ENTRY DATE: 2019-04-01
  ref <313>: RELEVANT RESIDUES IN SEQ ID NO: (1)..(1557)
tttacggagagtttgatcctggctcaggacgaacgctggcggcgtgcctaatacatgcaagtcgagcgaacagatgaggagcttgctcctctgacgttagcggcggacgggtgagtaacacgtgggcaacctgccctgcagattgggataactccgggaaaccggggctaataccgaataataaaaagaatctcctgattcttttttgaaaggcggcttttagctgtcactgcaggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgtcagggaagaacaagtaccatagtaactgatggtaccttgacggtacctgaccagaaagccacggctaactacgtgccagcagccgcggtaatacgtaggtggcaagcgttgtccggaattattgggcgtaaagcgcgcgcaggtggttccaaaagtctgatgtgaaagcccccggctcaaccggggagggtcattggaaactggggaacttgagtgcaggagaggaaagtggaattccacgtgtagcggtgaaatgcgtagatatgtggaggaacaccagtggcgaaggcgactttctggcctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccggtgaccgcactggagacagtgttttcccttcggggacaacggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacgatacaaagggctgcgagaccgcgaggtttagccaatcccataaaatcgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttctaa

SEQ ID NO: 4429 - DNA, 1455 bp, Jeotgalibacillus soli
  ref <308>: DATABASE ACCESSION NUMBER: NCBI ACCESSION: NZ_JXRP01000001.1
  ref <309>: DATABASE ENTRY DATE: 2019-04-01
  ref <313>: RELEVANT RESIDUES IN SEQ ID NO: (1)..(1455)
ggagagtttgatcctggctcaggacgaacgctggcggcgtgcctaatacatgcaagtcgagcgaatgacgaaggagcttgctccttctgatttagcggcggacgggtgagtaacacgtgggcaatctgcccgtaagactgggataactccgggaaaccggggctaataccggataatcccgatcctctcctgaggatcggttgaaagatggtttcggctatcacttacggatgagcccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaagctctgttgttagggaagaacacgtacgagagtaactgctcgtaccttgacggtacctaaccagaaagccacggctaactacgtgccagcagccgcggtaatacgtaggtggcaagcgttgtccggaattattgggcgtaaagcgcgcgcaggtggttctttaagtctgatgtgaaagcccccggctcaaccggggagggtcattggaaactggggaacttgagtgcaggagaggaaagtggaattccacgtgtagcggtgaaatgcgtagatatgtggaggaacaccagtggcgaaggcgactttctggcctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgccaacccaagagattgggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacgatacaaagggcagcaagaccgcgaggtggagccaatcccataaaatcgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacac

SEQ ID NO: 4430 - DNA, 1553 bp, Jeotgalibacillus sp. 22-7
  ref <308>: DATABASE ACCESSION NUMBER: NCBI ACCESSION: NZ_PREZ01000010.1
  ref <309>: DATABASE ENTRY DATE: 2019-04-01
  ref <313>: RELEVANT RESIDUES IN SEQ ID NO: (1)..(1553)
tttacggagagtttgatcctggctcaggacgaacgctggcggcgtgcctaatacatgcaagtcgagcggatcgtttggagcttgctccaaacgattagcggcggacgggtgagtaacacgtgggcaatctgcccgtaagactgggataactccgggaaaccggggctaataccggataattccggctctctcctgagagccggctgaaagatggtttcggctatcacttacggatgagcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacacgtacgagagtaactgctcgtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccccggctcaaccggggagggtcattggaaactggggaacttgagtgcaggagaggaaagtggaattccacgtgtagcggtgaaatgcgtagatatgtggaggaacaccagtggcgaaggcgactttctggcctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgcccggtctagagatagacttttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacgatacaaagggcagcgagaccgcgaggtggagctaatcccataaaatcgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgcctaaggtgggacagatgattggggtgaagtcgtaacaaggtagccgtatcggaaggtgcggctggatcacctcctttct

SEQ ID NO: 4431 - DNA, 1264 bp, Jeotgalicoccus halophilus
  ref <308>: DATABASE ACCESSION NUMBER: NCBI ACCESSION: NZ_FNFI01000025.1
  ref <309>: DATABASE ENTRY DATE: 2019-04-01
  ref <313>: RELEVANT RESIDUES IN SEQ ID NO: (1)..(1264)
atggagagtttgatcctggctcaggatgaacgctggcggcgtgcctaatacatgcaagtcgagcgcgaagatcaggagcttgctcctgagattcgagcggcggacgggtgagtaacacgtaggcaacctacccttgagattgggataactaccggaaacggtagctaataccggatacgacattcctgcataagtaagaatgttaaaaggcggatttatctgccgctcatggatgggcctgcggtgcattagctagttggtgagatagtagctcaccaaggcgacgatgcatagccgacctgagagggtgatcggccacactgggactgagacacggcccagactcctacgggaggcagcagtagggaatcttccgcaatggacgcaagtctgacggagcaacgccgcgtgagtgatgaagggtttcggctcgtaaaactctgttgttaaggaagaacacttgaggtagtaactggccttgagatgacggtacttaaccagaaagccacggctaactacgtgccagcagccgcggtaatacgtaggtggcaagcgttatccggaattattgggcgtaaagcgcgcgtaggcggtaaaataagtctgatgtgaaagcccccggctcaaccggggagggtcattggaaactgttttacttgagtacagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacagccatagagatatggtttcccttcggggcagagtgacaggtggtgcatggttgtcgtcagctcgtgtcgtgagatgttgggttaagtcccgcaacgagcgcaacccttaagtttagttgccatcattaagttgggcactctagactgactgccggtgacaaaccggaggaaggtggggacgacgtcaaatcatcatgccccttatgatttgggctacacacgtgctacaatggacaggttacaaagggcagc

SEQ ID NO: 4432 - DNA, 1551 bp, Jeotgalicoccus halotolerans
  ref <308>: DATABASE ACCESSION NUMBER: NCBI ACCESSION: NZ_QUMW01000006.1
  ref <309>: DATABASE ENTRY DATE: 2019-04-01
  ref <313>: RELEVANT RESIDUES IN SEQ ID NO: (1)..(1551)
atggagagtttgatcctggctcaggatgaacgctggcggcgtgcctaatacatgcaagtcgagcgcgagaatgaggagcttgctcctcatgatcgagcggcggacgggtgagtaacacgtaggcaacctacccttgagattgggataactaccggaaacggtagctaataccggatacgacttttccacataagtggaatggttaaaaggcggatttatctgccgctcatggatgggcctgcggtgcattagctagttggtgaggtagtggctcaccaaggcgacgatgcatagccgacctgagagggtgatcggccacactgggactgagacacggcccagactcctacgggaggcagcagtagggaatcttccgcaatggacgaaagtctgacggagcaacgccgcgtgagtgatgaagggtttcggctcgtaaaactctgttgttaaggaagaacacttgaggtagtaactggccttgagatgacggtacttaaccagaaagccacggctaactacgtgccagcagccgcggtaatacgtaggtggcaagcgttatccggaattattgggcgtaaagcgcgcgtaggcggtaaaataagtctgatgtgaaagcccccggctcaaccggggagggtcattggaaactgttttacttgagtacagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgacagccctagagatagggtttcccttcggggcagagtgacaggtggtgcatggttgtcgtcagctcgtgtcgtgagatgttgggttaagtcccgcaacgagcgcaacccttaagtttagttgccatcattaagttgggcactctagactgactgccggtgacaaaccggaggaaggtggggacgacgtcaaatcatcatgccccttatgatttgggctacacacgtgctacaatggacaggttacaaagggcagcgacgccgcgaggccaagcgaatcccataaaactgttctcagttcggattggagtctgcaactcgactccatgaagctggaatcgctagtaatcgtagatcagcatgctacggtgaatacgttcccgggtcttgtacacaccgcccgtcacaccacgaaagtcgataacacctgaagccggtgggccaacctttatggaggcagccgtcaaaggtgggattgataattggggtgaagtcgtaacaaggtagccgtatcggaaggtgcggctggatcacctcctttcta

SEQ ID NO: 4433 - DNA, 1246 bp, Jeotgalicoccus marinus
  ref <308>: DATABASE ACCESSION NUMBER: NCBI ACCESSION: NZ_AUEE01000029.1
  ref <309>: DATABASE ENTRY DATE: 2019-04-01
  ref <313>: RELEVANT RESIDUES IN SEQ ID NO: (1)..(1246)
gatcggccacactgggactgagacacggcccagactcctacgggaggcagcagtagggaatcttccgcaatggacgcaagtctgacggagcaacgccgcgtgagtgaagaagggtttcggctcgtaaaactctgttgttaaggaagaacactttaggtagtaactggcctagagatgacggtacttaaccagaaagccacggctaactacgtgccagcagccgcggtaatacgtaggtggcaagcgttatccggaattattgggcgtaaagcgcgcgtaggcggtagaataagtctgatgtgaaagcccccggctcaaccggggagggtcattggaaactgttttacttgagtgcagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgatcgccatagagatatggtttcccttttgggcagagagacaggtggtgcatggttgtcgtcagctcgtgtcgtgagatgttgggttaagtcccgcaacgagcgcaacccttaaatttagttgccatcattcagttgggcactctagattgactgccggtgacaaaccggaggaaggtggggatgacgtcaaatcatcatgccccttatgatttgggctacacacgtgctacaatgggcaggttacaaagggcagcgaagccgcgaggccaagcgaatcccataaaactgttctcagttcggattggagtctgcaactcgactccatgaagctggaatcgctagtaatcgtagatcagcatgctacggtgaatacgttcccgggtcttgtacacaccgcccgtcacaccacgaaagtcgataacacctgaagccggtggactaaccttaatggaggtagccgtcaaaggtgggattgataattggggtgaagtcgtaacaaggtagccgtatcggaaggtgcggctggatcacctcctttctaagga

SEQ ID NO: 4434 - DNA, 1557 bp, Jeotgalicoccus psychrophilus
  ref <308>: DATABASE ACCESSION NUMBER: NCBI ACCESSION: NZ_AUEF01000032.1
  ref <309>: DATABASE ENTRY DATE: 2019-04-01
  ref <313>: RELEVANT RESIDUES IN SEQ ID NO: (1)..(1557)
atggagagtttgatcctggctcaggatgaacgctggcggcgtgcctaatacatgcaagtcgagcgcaaagatcaggagcttgctcctgtgatttgagcggcggacgggtgagtaacacgtaggcaacctacccttgagattgggataactaccggaaacggtagctaataccggatacgacctttccacataagtggaattgttaaaaggcggatttatctgccgctcatggatgggcctgcggtgcattagctagttggtgagatagtagctcaccaaggcgacgatgcatagccgacctgagagggtgatcggccacactgggactgagacacggcccagactcctacgggaggcagcagtagggaatcttccgcaatggacgaaagtctgacggagcaacgccgcgtgagtgatgaagggtttcggctcgtaaaactctgttgttaaggaagaatacttgaggtagtaactggccttgagatgacggtacttaaccagaaagccacggctaactacgtgccagcagccgcggtaatacgtaggtggcaagcgttatccggaattattgggcgtaaagcgcgcgtaggcggtaaaataagtctgatgtgaaagcccccggctcaaccggggagggtcattggaaactgttttacttgagtacagaagaggagagtggaattccatgtgtagcggtgaaatgcgcagagatatggaggaacaccagtggcgaaggcggctctctggtctgttactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacaactgtagagatacagcttcccttcggggcagagtgacaggtggtgcatggttgtcgtcagctcgtgtcgtgagatgttgggttaagtcccgcaacgagcgcaacccttaagtttagttgccatcattaagttgggcactctagactgactgccggtgacaaaccggaggaaggtggggacgacgtcaaatcatcatgccccttatgatttgggctacacacgtgctacaatggacaggttacaaagggcagcaacgccgcgaggccaagcgaatcccataaaactgttctcagttcggattggagtctgcaactcgactccatgaagctggaatcgctagtaatcgtagatcagcatgctacggtgaatacgttcccgggtcttgtacacaccgcccgtcacaccacggaagtcgataacacctgaagccggtgggccaaccatttatggaggcagccgtcgaaggtgggatggatgactggggtgaagtcgtaacaaggtagccgtatcggaaggtgcggctggatcacctcctttctaaggaa

SEQ ID NO: 4435 - DNA, 1557 bp, Jeotgalicoccus saudimassiliensis
  ref <308>: DATABASE ACCESSION NUMBER: NCBI ACCESSION: NZ_CCSE01000001.1
  ref <309>: DATABASE ENTRY DATE: 2019-04-01
  ref <313>: RELEVANT RESIDUES IN SEQ ID NO: (1)..(1557)
atcatggagagtttgatcctggctcaggatgaacgctggcggcgtgcctaatacatgcaagtcgagcgcgagattgaggagcttgctcctcatgatcgagcggcggacgggtgagtaacacgtaggcaacctacccttgagattgggataactaccggaaacggtagctaataccggatacgacatagtcacaaaagtgattgtgttaaaaggcggatttatctgccgctcatggatgggcctgcggtgcattagctagttggtgagatagaagctcaccaaggcgacgatgcatagccgacctgagagggtgatcggccacactgggactgagacacggcccagactcctacgggaggcagcagtagggaatcttccgcaatggacgaaagtctgacggagcaacgccgcgtgagtgatgaagggtttcggctcgtaaaactctgttgttaaggaagaatacttgaggtagtaactggccttgagatgacggtacttaaccagaaagccacggctaactacgtgccagcagccgcggtaatacgtaggtggcaagcgttatccggaattattgggcgtaaagcgcgcgtaggcggtaaaataagtctgatgtgaaagcccccggctcaaccggggagggtcattggaaactgttttacttgagtacagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgacaactgtagagatacagcttcccttcggggcagagtgacaggtggtgcatggttgtcgtcagctcgtgtcgtgagatgttgggttaagtcccgcaacgagcgcaacccttaagtttagttgccatcattaagttgggcactctagactgactgccggtgacaaaccggaggaaggtggggacgacgtcaaatcatcatgccccttatgatttgggctacacacgtgctacaatggacaggttacaaagggcagcaacgccgcgaggccaagcgaatcccataaaactgttctcagttcggattggagtctgcaactcgactccatgaagctggaatcgctagtaatcgtagatcagcatgctacggtgaatacgttcccgggtcttgtacacaccgcccgtcacaccacggaagtcgataacacctgaagccggtgggccaaccttttggaggcagccgtcgaaggtgggattgatgactggggtgaagtcgtaacaaggtagccgtatcggaaggtgcggctggatcacctcctttctaagga

SEQ ID NO: 4436 - DNA, 1468 bp, Jhaorihella thermophila
  ref <308>: DATABASE ACCESSION NUMBER: NCBI ACCESSION: NZ_FNVD01000047.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgagcgaacccttcggggttagcggcggacgggtgagtaacgcgtgggaacgtgcccttcagttcggaatagcccatggaaacgtggagtaataccggatacgccctttgggggaaagatttatcgctgagggatcggcccgcgtctgattaggtagttggtggggtaacggcctaccaagcctacgatcagtagctggttttagaggatgatcagccacactgggactgagacacggcccagactcctacgggaggcagcagtggggaatcttggacaatgggggcaaccctgatccagccatgccgcgtgtgtgatgaagcccttaggggtgtaaagcactttcagtcgtgaagataatgacggtagcgacagaagaagccccggctaactccgtgccagcagccgcggtaatacggagggggctagcgttgttcggaattactgggcgtaaagcgcgcgtaggcgggctgttaagtcaggggtgaaatcccggggctcaaccccggaactgcctttgatactggcagcctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcccgggaccggcccagagatgggtcttccacttcggtggctcggtgacaggtgctgcatggctgtcgtcagctcgtgtcgtgagatgttcggttaagtccggcaacgagcgcaacccacgcccttagttaccatcggttcggccggggactctaagggaactgcccgcgacaagcgggaggaaggtgtggatgacgtcaagtcctcatggcccttacgggttgggctacacacgtgctacaatggcggtgacagtgggttaatccccaaaagccgtctcagttcggattgtcctctgcaactcgagggcatgaagtcggaatcgctagtaatcgcgtaacagcatgacgcggtgaatacgttcccgggccttgtacacaccgcccgtcacaccatgggagttggttctacccgacgacgctgcgctaaccctttcgggaggcaggcggccacggtaggatcagcgactggggtgaagtcgtaacaaggtagccgtaggggaacctgcggctggatcacctcctttctaa

SEQ ID NO: 4437 - DNA, 1531 bp, Jiangella sp. KE2-3
  ref <308>: DATABASE ACCESSION NUMBER: NCBI ACCESSION: NZ_QVAI01000045.1
  ref <309>: DATABASE ENTRY DATE: 2019-04-01
  ref <313>: RELEVANT RESIDUES IN SEQ ID NO: (1)..(1531)
ttgatggagagtttgatcctggctcaggacgaacgctggcggcgtgcttaacacatgcaagtcgagcggaaaggcccttcggggtactcgagcggcgaacgggtgagtaacacgtgggtaacctgccttcagctctgggataagcctgggaaactgggtctaataccggatatgacgtgccaccgcatggtgtgtgcgtggaaagtttttcggctggagatggactcgcggcctatcagcttgttggtggggtagtggcctaccaaggcgatgacgggtagccggcctgagagggcgaccggccacactgggactgagacacggcccagactcctacgggaggcagcagtggggaatattgcgcaatgggcgaaagcctgacgcagcaacgccgcgtgagggatgacggccttcgggttgtaaacctctttcagcgctgacgaagccttcgggtgacggtaggcgcagaagaagcaccggctaactacgtgccagcagccgcggtaatacgtagggtgcgagcgttgtccggaattattgggcgtaaagggctcgtaggcggtctgttgcgtctgctgtgaaagcccggggcttaaccccgggtctgcagtggatacgggcaggctagagtccggcaggggagactggaattcctggtgtagcggtggaatgcgcagatatcaggaggaacaccggtggcgaaggcgggtctctgggccggtactgacgctgaggagcgaaagcgtggggagcgaacaggattagataccctggtagtccacgccgtaaacgttgggcgctaggtgtgggttcccttccacggggtccgtgccgtagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacacggaaatccggcagagatgtcgggtccttttagggtcgtgtacaggtggtgcatggctgtcgtcagctcgtgtcgtgagatgttgggttaagtcccgcaacgagcgcaaccctcgtcccatgttgccagcgggttatgccggggactcatgggagactgccggggtcaactcggaggaaggtggggatgacgtcaagtcatcatgccccttatgtccagggcttcacgcatgctacaatggccggtacaaagggctgcgataccgtaaggtggagcgaatcccaaaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagcccatggcctaaccccttgtgggagggagtggtcgaaggtgggactggcgattaggacgaagtcgtaacaaggtagccgtaccggaaggtgcggctggatcacctcctttctaaggagca

SEQ ID NO: 4438 - DNA, 1528 bp, Jiangella sp. NEAU-YY265
  ref <308>: DATABASE ACCESSION NUMBER: NCBI ACCESSION: NZ_QUAL01000243.1
  ref <309>: DATABASE ENTRY DATE: 2019-04-01
  ref <313>: RELEVANT RESIDUES IN SEQ ID NO: (1)..(1528)
ttgatggagagtttgatcctggctcaggacgaacgctggcggcgtgcttaacacatgcaagtcgagcggaaaggcccttcggggtactcgagcggcgaacgggtgagtaacacgtgggtaacctgccttcagctctgggataagcctgggaaactgggtctaataccggatatgacatgcggccgcatggttgtgtgtggaaagtttttcggctggagatggactcgcggcctatcagcttgttggtggggtagtggcctaccaaggcgatgacgggtagccggcctgagagggcgaccggccacactgggactgagacacggcccagactcctacgggaggcagcagtggggaatattgcgcaatgggcgaaagcctgacgcagcaacgccgcgtgagggatgacggccttcgggttgtaaacctctttcagcgctgacgaagctttcgggtgacggtaggcgcagaagaagcaccggctaactacgtgccagcagccgcggtaatacgtagggtgcgagcgttgtccggaattattgggcgtaaagggctcgtaggcggtttgtcgcgtctgctgtgaaagcccggggcttaaccccgggtctgcagtggatacgggcaggctagagtccggcaggggagactggaattcctggtgtagcggtggaatgcgcagatatcaggaggaacaccggtggcgaaggcgggtctctgggccggtactgacgctgaggagcgaaagcgtggggagcgaacaggattagataccctggtagtccacgccgtaaacgttgggcgctaggtgtgggttcccttccacgggatccgtgccgtagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatacacggaaatccggcagagatgtcgggtccttttagggtcgtgtacaggtggtgcatggctgtcgtcagctcgtgtcgtgagatgttgggttaagtcccgcaacgagcgcaaccctcgtcccatgttgccagcacgtaatggtggggactcatgggagactgccggggtcaactcggaggaaggtggggatgacgtcaagtcatcatgccccttatgtccagggcttcacgcatgctacaatggccggtacaaagggctgcgataccgtgaggtggagcgaatcccaaaaagccggtctcagttcggatcggggtctgcaactcgaccccgtgaagttggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggactggcgattaggacgaagtcgtaacaaggtagccgtaccggaaggtgcggctggatcacctcctttctaaggag

SEQ ID NO: 4439 - DNA, 1539 bp, Jishengella endophytica
  ref <308>: DATABASE ACCESSION NUMBER: NCBI ACCESSION: NZ_QXIQ01000098.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 4440 - DNA, 1525 bp, Jishengella sp. AZ1-13
  ref <308>: DATABASE ACCESSION NUMBER: NCBI ACCESSION: NZ_QXEC01000057.1
  ref <309>: DATABASE ENTRY DATE: 2019-04-01
  ref <313>: RELEVANT RESIDUES IN SEQ ID NO: (1)..(1525)
tgttggagagtttgatcctggctcaggacgaacgctggcggcgtgcttaacacatgcaagtcgagcggaaaggcccttcggggtactcgagcggcgaacgggtgagtaacacgtgagcaacctgccctaggctttgggataaccctcggaaacgggggctaataccggatattcacttgcggacgcatgtttgtgggtggaaagtttttcggcttgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgtggctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatcgccggaaatcctgcagagatgtggggtccttcggggccggtgacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 4441 - DNA, 1538 bp, Jonquetella anthropi
  ref <308>: DATABASE ACCESSION NUMBER: NCBI ACCESSION: NZ_CM001376.1
  ref <309>: DATABASE ENTRY DATE: 2019-04-01
  ref <313>: RELEVANT RESIDUES IN SEQ ID NO: (1)..(1538)
ttttttggagagtttgatcctggctcaggataaacgctggcggcgtgcttaacacatgcaagttggacgggaatactcgaggaagagacttcggttaattttttgggtatgagagtagcggacgggtgagtaatgcataagaatctatccatcagagggggacaactgcgggaaaccggagctaataccccgtaagccggaaggtgaaagggagcaatccgctgatggaggagcttgtgtcctatcaggtagttggtgaggtaagagctcaccaagccgaagacgggtagccggactgagaggttgtacggccacattggaactgagagacggtccagactcctacgggaggcagcagtggggaatattgggcaatgggcgaaagcctgacccagcgacgccgcgtgagggaagacggccttcgggttgtaaacctctgttgcaggggaagaaggaagtgacggtaccctgcgaggaagctccggcaaactacgtgccagcagccgcggtaatacgtagggagcgagcgttatccggaattactgggcgtaaagggcgcgtaggcggaatggcaagtcagcaagtgaaagcgtggggctcaaccccatgatgcggctgaaactgttattctagaggcatggagaggcaaacggaattcccggtgtagcggtgaaatgcgtagatatcgggaagaacaccagtggcgaaggcggtttgctggccatgaactgacgctcatagcgcgaaagctagggtagcaaacgggattagataccccggtagtcctagcagtaaacgatgtatgctgggtgtgggtgtagcgatacatccgtgccgaagttaacgcgataagcataccgcctggggagtacggtcgcaagattgaaactcaaaggaattgacgggggcccgcacaagcggtggagcacgtggtttaattcgatgcaaaccgaagaaccttacctgggcttgacatgtaaggaaaggtgtatggagacgtacaagtgtactgcttcggtagtacgccttacacaggtgctgcatggctgtcgtcagctcgtgtcgtgagatgttgggttaagtcccgcaacgagcgcaacccctattgccagttgctaacaggtagagctgagcactcaggcgagactgccgccgacaaggtggaggaaggtggggatgacgtcaagtcatcatggcccttatgcccagggccacacacatgctacaatggccggtacaaagggaagcgaggctgcgaagcggagcgaaccccaaaagccggtcccagttcggattgcagtctgcaactcgactgcatgaagttggaatcgctagtaatcgcgaatcagcgaagtcgcggtgaatacgttcccgggccttgtacacaccgcccgtcacaccatccgagttggatgcactccaagtcggtatctcaaccgcaaggggggagccgcccaaagtgtgtctggtgaggagggtgaagtcgtaacaaggtagccgtaccggaaggtgcggctggatcacctcctttctaagga

SEQ ID NO: 4442 - DNA, 1538 bp, Jonquetella sp. BV3C21
  ref <308>: DATABASE ACCESSION NUMBER: NCBI ACCESSION: NZ_AWWC01000004.1
  ref <309>: DATABASE ENTRY DATE: 2019-04-01
  ref <313>: RELEVANT RESIDUES IN SEQ ID NO: (1)..(1538)
ttttttggagagtttgatcctggctcaggataaacgctggcggcgtgcttaacacatgcaagttggacgggaatactcgaggaagagacttcggttaattttttgggtatgagagtagcggacgggtgagtaatgcataagaatctatccatcagagggggacaactgcgggaaaccggagctaataccccgtaagccggaaggtgaaagggagcaatccgctgatggaggagcttgtgtcctatcaggtagttggtgaggtaagagctcaccaagccgaagacgggtagccggactgagaggttgtacggccacattggaactgagagacggtccagactcctacgggaggcagcagtggggaatattgggcaatgggcgaaagcctgacccagcgacgccgcgtgagggaagacggccttcgggttgtaaacctctgttgcaggggaagaaggaagtgacggtaccctgcgaggaagctccggcaaactacgtgccagcagccgcggtaatacgtagggagcgagcgttatccggaattactgggcgtaaagggcgcgtaggcggaatgacaagtcagcaagtgaaagcgtggggctcaaccccatgatgcggctgaaactgttattctagaggcatggagaggcaaacggaattcccggtgtagcggtgaaatgcgtagatatcgggaagaacaccagtggcgaaggcggtttgctggccatgaactgacgctcatagcgcgaaagctagggtagcaaacgggattagataccccggtagtcctagcagtaaacgatgtatgctgggtgtgggtgtagcgatacatccgtgccgaagttaacgcgataagcataccgcctggggagtacggtcgcaagattgaaactcaaaggaattgacgggggcccgcacaagcggtggagcacgtggtttaattcgatgcaaaccgaagaaccttacctgggcttgacatgtaaggaaaggtgtatggagacgtacaagtgtactgcttcggtagtacgccttacacaggtgctgcatggctgtcgtcagctcgtgtcgtgagatgttgggttaagtcccgcaacgagcgcaacccctattgccagttgctaacaggtagagctgagcactcaggcgagactgccgccgacaaggtggaggaaggtggggatgacgtcaagtcatcatggcccttatgcccagggccacacacatgctacaatggccggtacaaagggaagcgaggctgcgaagcggagcgaaccccaaaagccggtcccagttcggattgcagtctgcaactcgactgcatgaagttggaatcgctagtaatcgcgaatcagcgaagtcgcggtgaatacgttcccgggccttgtacacaccgcccgtcacaccatccgagttggatgcactccaagtcggtatctcaaccgcaaggggggagccgcccaaagtgtgtctggtgaggagggtgaagtcgtaacaaggtagccgtaccggaaggtgcggctggatcacctcctttctaagga

SEQ ID NO: 4443 - DNA, 716 bp, Kaistia adipata
  ref <308>: DATABASE ACCESSION NUMBER: NCBI ACCESSION: NZ_AUHO01000002.1
  ref <309>: DATABASE ENTRY DATE: 2019-04-01
  ref <313>: RELEVANT RESIDUES IN SEQ ID NO: (1)..(716)
gcttgctcttcggtggcgcagctaacgcattaagcatcccgcctggggagtacggtcgcaagattaaaactcaaaggaattgacgggggcccgcacaagcggtggagcatgtggtttaattcgaagcaacgcgcagaaccttaccagctcttgacatgtctcgtatgggtaccggagacggtatccttcagttcggctggcgagaacacaggtgctgcatggctgtcgtcagctcgtgtcgtgagatgttgggttaagtcccgcaacgagcgcaaccctcgcctctagttgccatcattcagttgggcactctagagggactgccggtgataagccgagaggaaggtggggatgacgtcaagtcctcatggcccttacgggctgggctacacacgtgctacaatggcggtgacaatgggcagcgaaggggcgacccggagctaatctcaaaaagccgtctcagttcggattgtactctgcaactcgagtgcatgaagttggaatcgctagtaatcgtggatcagcatgccacggtgaatacgttcccgggccttgtacacaccgcccgtcacaccatgggagttggttttacccgaaggcgttgcgctaacccagcaatgggaggcaggcgaccacggtagggtcagcgactggggtgaagtcgtaacaaggtagccgtaggggaacctgcggctggatcacctcctttctaagga

SEQ ID NO: 4444 - DNA, 1493 bp, Kaistia algarum
  ref <308>: DATABASE ACCESSION NUMBER: NCBI ACCESSION: NZ_PSNV01000052.1
  ref <309>: DATABASE ENTRY DATE: 2019-04-01
  ref <313>: RELEVANT RESIDUES IN SEQ ID NO: (1)..(1493)
tcaatatgagagtttgatcctggctcagaacgaacgctggcggcaggcctaacacatgcaagtcgaacgccccgcaaggggagtggcagacgggtgagtaacgcgtgggaacctaccttgtggtacggaacaaccaagggaaactttggctaataccgtatgagcccttagggggaaagatttatcgccataagatgggcccgcgtaggattagctagttggtgaggtaatggctcaccaaggcgacgatccttagctggtctgagaggatgaccagccacactgggactgagacacggcccagactcctacgggaggcagcagtggggaatattggacaatgggcgcaagcctgatccagccatgccgcgtgtgtgatgaaggccttagggttgtaaagcactttcgccgatgaagataatgactgtagtcggagaagaagccccggctaacttcgtgccagcagccgcggtaatacgaagggggcaagcgttgttcggatttactgggcgtaaagcgtacgtaggcggattgttaagtgaggggtgaaatcccggggctcaacctcggaactgcctttcatactggcaatcttgagtccgggagaggtgagtggaactcctagtgtagaggtgaaattcgtagatattaggaagaacaccagtggcgaaggcggctcactggcccggaactgacgctgaggtacgaaagcgtggggagcaaacaggattagataccctggtagtccacgccgtaaacgatggatgctagccgtcggggagcttgctcttcggtggcgcagctaacgcattaagcatcccgcctggggagtacggtcgcaagattaaaactcaaaggaattgacgggggcccgcacaagcggtggagcatgtggtttaattcgaagcaacgcgcagaaccttaccagctcttgacatgtcccgtatgagttccggagacggatctcttcagttcggctggcgggaacacaggtgctgcatggctgtcgtcagctcgtgtcgtgagatgttgggttaagtcccgcaacgagcgcaaccctcgcctctagttgccatcatttagttgggcactctagagggactgccggtgataagccgagaggaaggtggggatgacgtcaagtcctcatggcccttacgggctgggctacacacgtgctacaatggcggtgacagtgggcagctacttcgcgaggagaagctaatcccaaaaaaccgtctcagttcggattgcactctgcaactcgagtgcatgaagttggaatcgctagtaatcgtggatcagcatgccacggtgaatacgttcccgggccttgtacacaccgcccgtcacaccatgggagttgggtttacccgaaggcagtgcgctaacccgcaagggaggcagctgaccacggtaggctcagcgactggggtgaagtcgtaacaaggtagccgtaggggaacctgcggctggatcacctcctttctaag

SEQ ID NO: 4445 - DNA, 1499 bp, Kaistia granuli
  ref <308>: DATABASE ACCESSION NUMBER: NCBI ACCESSION: NZ_AQYH01000011.1
  ref <309>: DATABASE ENTRY DATE: 2019-04-01
  ref <313>: RELEVANT RESIDUES IN SEQ ID NO: (1)..(1499)
ttcaatttgagagtttgatcctggctcagaacgaacgctggcggcaggcctaacacatgcaagtcgaacgccctagcaatagggagtggcagacgggtgagtaacgcgtgggaatctaccttgtggtacggaacaaccaagggaaactttggctaataccgtatgagcccttcgggggaaagatttatcgccataagatgagcccgcgtaggattagctagttggtgaggtaatggctcaccaaggcgacgatccttagctggtctgagaggatgaccagccacactgggactgagacacggcccagactcctacgggaggcagcagtggggaatattggacaatgggcgcaagcctgatccagccatgccgcgtgtgtgatgaaggccttagggttgtaaagcactttcgccgatgaagataatgactgtagtcggagaagaagccccggctaacttcgtgccagcagccgcggtaatacgaagggggctagcgttgttcggaattactgggcgtaaagcgtacgtaggcggatcgttaagttaggggtgaaatcccgaggctcaacctcggaactgcctctgatactggcgatcttgagtccgggagaggtgagtggaactcctagtgtagaggtgaaattcgtagatattaggaagaacaccagtggcgaaggcggctcactggcccggaactgacgctgaggtacgaaagcgtggggagcaaacaggattagataccctggtagtccacgccgtaaacgatggatgctagccgtcggggagcttgctcttcggtggcgcagctaacgcattaagcatcccgcctggggagtacggtcgcaagattaaaactcaaaggaattgacgggggcccgcacaagcggtggagcatgtggtttaattcgaagcaacgcgcagaaccttaccagctcttgacatgtcacgtatgggtaccggagacggtatccttcagttcggctggcgtgaacacaggtgctgcatggctgtcgtcagctcgtgtcgtgagatgttgggttaagtcccgcaacgagcgcaaccctcgcctctagttgccatcattcagttgggcactctagagggactgccggtgataagccgagaggaaggtggggatgacgtcaagtcctcatggcccttacgggctgggctacacacgtgctacaatggcggtgacaatgggcagcgaaagggcgacctggagctaatctcaaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggcgttgcgctaacccagcaatgggaggcaggcgaccacggtagggtcagcgactggggtgaagtcgtaacaaggtagccgtaggggaacctgcggctggatcacctcctttctaagg

SEQ ID NO: 4446 - DNA, 1496 bp, Kaistia soli
  ref <308>: DATABASE ACCESSION NUMBER: NCBI ACCESSION: NZ_FQUP01000004.1
  ref <309>: DATABASE ENTRY DATE: 2019-04-01
  ref <313>: RELEVANT RESIDUES IN SEQ ID NO: (1)..(1496)
attcaatatgagagtttgatcctggctcagaacgaacgctggcggcaggcctaacacatgcaagtcgaacgccccgcaaggggagtggcagacgggtgagtaacgcgtgggaacctaccttgtggtacggaacaaccaagggaaactttggctaataccgtatgagcccttagggggaaagatttatcgccatgagatgggcccgcgtaggattagctagttggtgaggtaacggctcaccaaggcgacgatccttagctggtctgagaggatgaccagccacactgggactgagacacggcccagactcctacgggaggcagcagtggggaatattggacaatgggcgcaagcctgatccagccatgccgcgtgtgtgatgaaggccttagggttgtaaagcactttcgccgatgaagataatgacggtagtcggagaagaagccccggctaacttcgtgccagcagccgcggtaatacgaagggggcaagcgttgttcggatttactgggcgtaaagcgtacgtaggcggataattaagtcaggggtgaaatcccgaggctcaacctcggaactgcctttgatactggttatcttgagtccgggagaggtgagtggaactcctagtgtagaggtgaaattcgtagatattaggaagaacaccagtggcgaaggcggctcactggcccggaactgacgctgaggtacgaaagcgtggggagcaaacaggattagataccctggtagtccacgccgtaaacgatggatgctagccgtcggggagcttgctcttcggtggcgcagctaacgcattaagcatcccgcctggggagtacggtcgcaagattaaaactcaaaggaattgacgggggcccgcacaagcggtggagcatgtggtttaattcgaagcaacgcgcagaaccttaccagctcttgacatgtcacgtatgaattccagagatggatttcttcagttcggctggcgtgaacacaggtgctgcatggctgtcgtcagctcgtgtcgtgagatgttgggttaagtcccgcaacgagcgcaaccctcgcctctagttgccatcattaagttgggcactctagagggactgccggtgataagccgagaggaaggtggggatgacgtcaagtcctcatggcccttacgggctgggctacacacgtgctacaatggcggtgacagtgggcagctacttcgcgaggagaagctaatcccaaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttctaagg

SEQ ID NO: 4447 - DNA, 1493 bp, Kamptonema formosum
  ref <308>: DATABASE ACCESSION NUMBER: NCBI ACCESSION: NZ_KB235903.1
  ref <309>: DATABASE ENTRY DATE: 2019-04-01
  ref <313>: RELEVANT RESIDUES IN SEQ ID NO: (1)..(1493)
atcacggagagtttgatcctggctcaggatgaacgctggcggtctgcttaacacatgcaagtcgaacgggtgtagcaatacattagtggcggacgggtgagtaacgcgtgagaatctgccaacaggactgggacaacagtgggaaaccgctgctaatcccggatgtaccgcaagggaaaagatttatcgcctgttgatgagctcgcgtctgattagctagttggtggggtaaaagcctaccaaggcatcgatcagtagctggtctgagaggacgatcagccacactgggactgagacacggcccagactcctacgggaggcagcagtggggaattttccgcaatgggcgaaagcctgacggagcaagaccgcgtgagggaggaaggctcttgggttgtaaacctcttttctctgggaagaacaaaatgacggtaccagaggaatcagcatcggctaactccgtgccagcagccgcggtaagacggaggatgcaagcgttatccggaatgattgggcgtaaagcgtccgcaggtggcaattcaagtctgctgttaaagcgcagggcttaactctgtaaaggcagtggaaactgaatagctagagtgtggtaggggcagagggaattcccagtgtagcggtgaaatgcgtagagattgggaagaacatcggtggcgaaggcgctctgctggaccataactgacactcacaggacgaaagctaggggagcgaatgggattagataccccagtagtcctagccgtaaacgatggatactaggtgttgtctgtatcgacccggacagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatgtcgcgaatctgagtgaaagctcggagtgccttcgggagcgcgaacacaggtggtgcatggctgtcgtcagctcgtgtcgtgagatgttgggttaagtcccgcaacgagcgcaaccctcgtttttagttgccagcattaagttgggcactctaaagagactgccggtgacaaaccggaggaaggtggggatgacgtcaagtcagcatgccccttacgtcctgggctacacacgtactacaatggtagggacagagggcagccaactcgcgagagtgagctaatcccgtaaaccctgcctcagttcagatcgcaggctgcaactcgcctgcgtgaaggcggaatcgctagtaatcgccggtcagcatacggcggtgaatccgttcccgggccttgtacacaccgcccgtcacaccatggaagttggccatgcccgaagtcgttactctaactcgcaagagaggaggatgccgaaggcagggctgatgactggggtgaagtcgtaacaaggtagccgtaccggaaggtgtggctggatcacctcctttt

SEQ ID NO: 4448 - DNA, 1467 bp, Ketogulonicigenium robustum
  ref <308>: DATABASE ACCESSION NUMBER: NCBI ACCESSION: NZ_CP019937.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgggaccttcgggtctagcggcggacgggttagtaacacgtgggaacgtacctctctctacggaatagcctcgggaaactgagcgtaataccgtatacgccctttgggggaaagatttatcggagagagatcggcccgcgtctgattagatagttggtggggtaatggcctaccaagtctacgatcagtagctggtttgagaggatgatcagcaacactgggactgagacacggcccagactcctacgggaggcagcagtggggaatcttagacaatgggcgcaagcctgatctagccatgccgcgtgagtgaagaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggattagaaagttaggggtgaaatcccagggctcaaccctggaactgcctctaaaactcctagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcaggttgcttgcaacttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacattacaggaccggcctagagataggtctttcacttcggtgacctgtggacaggtgctgcatggctgtcgtcagctcgtgtcgtgagatgttcggttaagtccggcaacgagcgcaacccacgtctttagttgccagcattcagttgggcactctaaagaaactgccggtgataagccggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaaggcggtgcgctaaccagcaatggaagcagccgaccacggtaggctcagcgactggggtgaagtcgtaacaaggtagccgtaggggaacctgcggctggatcacctcctttctaa

SEQ ID NO: 4449 - DNA, 1467 bp, Ketogulonicigenium vulgare
  ref <308>: DATABASE ACCESSION NUMBER: NCBI ACCESSION: NZ_CP017622.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgggaccttcgggtctagcggcggacgggttagtaacacgtgggaacgtacctctctctacggaatagcctcgggaaactgagcgtaataccgtatacgccctttgggggaaagatttatcggagagagatcggcccgcgtctgattagatagttggtggggtaatggcctaccaagtctacgatcagtagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggattagaaagttaggggtgaaatcccagggctcaaccctggaactgcctctaaaactcctagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcaggttgcttgcaacttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacattacaggaccggcctagagataggtctttcacttcggtgacctgtggacaggtgctgcatggctgtcgtcagctcgtgtcgtgagatgttcggttaagtccggcaacgagcgcaacccacatctttagttgccagcattcagttgggcactctaaagaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaaggcggtgcgctaaccagcaatggaagcagccgaccacggtaggttcagcgactggggtgaagtcgtaacaaggtagccgtaggggaacctgcggctggatcacctcctttctaa

SEQ ID NO: 4450 - DNA, 1518 bp, Khelaifiella massiliensis
  ref <308>: DATABASE ACCESSION NUMBER: NCBI ACCESSION: NZ_LT854637.1
  ref <309>: DATABASE ENTRY DATE: 2019-04-01
  ref <313>: RELEVANT RESIDUES IN SEQ ID NO: (1)..(1518)
tttaaattgagagtttgatcctggctcaggacgaacgctggcggcgtgcctaacacatgcaagtcgagcgatgaagttcccttcggggaacggattagcggcggacgggtgagtaacacgtgggcaacctgcctcaaagaggggaatagcctcccgaaagggagattaataccgcataaaattacgaaatcacatggttttgtaatcaaaggagtaatccgctttgagatgggcccgcggcgcattagctagttggtaaggtaaaggcttaccaaggcgacgatgcgtagccgacctgagagggtgatcggccacattggaactgagacacggtccagactcctacgggaggcagcagtggggaatattgcgcaatgggggaaaccctgacgcagcaacgccgcgtgagtgatgaaggccttagggttgtaaagctctgttatctgggacgataatgacggtaccagaggaggaagccacggctaactacgtgccagcagccgcggtaatacgtaggtggcgagcgttgtccggatttactgggcgtaaagagtgcgtaggcggatgtttaagtgagatgtgaaatacccgagctcaacttgggtgctgcatttcaaactgggcatctagagtgcaggagaggaaagcggaattcctagtgtagcggtgaaatgcgtagagattaggaagaacaccagtggcgaaggcggctttctggactgtaactgacgctgaggcacgaaagcgtggggagcaaacaggattagataccctggtagtccacgccgtaaacgatgggtactaggtgtcgggggtccaacctcggtgccgcagtaaacacattaagtaccccgcctggggagtacggtcgcaagattaaaactcaaaggaattgacgggggcccgcacaagcagcggagcatgtggtttaattcgaagcaacgcgaagaaccttacctagacttgacatcccaagaatactgtggaaacacggtagtgcccttcggggaacttggtgacaggtggtgcatggttgtcgtcagctcgtgtcgtgagatgttgggttaagtcccgcaacgagcgcaacccctattgttagttgctaccattaagttgagcactctagcaagactgcctgggttaaccaggaggaaggtggggatgacgtcaaatcatcatgccccttatgtctagggctacacacgtgctacaatggtcggtacaacgagacgcaagaccgtgaggtggagcaaatctcaaaaaccgatctcagttcggattgtaggctgcaactcgcctacatgaagctggagttgctagtaatcgcgaatcagaatgtcgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggctggatcacctcctttcta

SEQ ID NO: 4451 - DNA, 1506 bp, Kiloniella majae
  ref <308>: DATABASE ACCESSION NUMBER: NCBI ACCESSION: NZ_MTSZ01000001.1
  ref <309>: DATABASE ENTRY DATE: 2019-04-01
  ref <313>: RELEVANT RESIDUES IN SEQ ID NO: (1)..(1506)
aggtcaacttgagagtttgatcctggctcagaacgaacgctggcggcaggcttaacacatgcaagtcgaacgagaaggtactttcgggtactggacagtggcgcacgggtgagtaacgcgtgggaatctaccatggagtgggggataacagttggaaacgactgctaataccgcatacgccctacgggggaaagatttattgctctatgatgagcccgcgttagattaggtagttggtggggtaatggcctaccaagcctacgatctatagctggtctgagaggatgatcagccacactgggactgagacacggcccagactcctacgggaggcagcagtggggaatattggacaatgggggcaaccctgatccagccatgccgcgtgagtgaagaaggccttagggttgtaaaactctttcaactgtgaggatgatgacagtagcagtagaagaagcaccggctaacttcgtgccagcagccgcggtaatacgaagggtgcgagcgttgttcggaattactgggcgtaaagggcgtgtaggcggattgcaaagatagaggtgaaaggcctgggctcaacctgggaactgcctttataacttgcagtctagagatcgagagaggatagcggaattcctagtgtagaggtgaaattcgtagatattaggaagaacaccagtggcgaaggcggctatctggctcgatactgacgctgaggcgcgaaagcgtggggagcaaacaggattagataccctggtagtccacgccgtaaacgatgtgaactagtcgtcaggatgcttgcatcttggtgacggagctaacgtattaagttcaccgcctggggagtacggtcgcaagattaaaactcaaaggaattgacgggggcccgcacaagcggtggagcatgtggtttaattcgaagcaacgcgcagaaccttaccagcccttgacataccaatcgcggtttccagagatggattccttcagttcggctggattggatacaggtgctgcatggctgtcgtcagctcgtgtcgtgagatgttgggttaagtcccgcaacgagcgcaacccctgcctttagttgccatcattaagttgggcactctagagggactgccggtgataagccggaggaaggcggggatgacgtcaagtcctcatggcccttatgggctgggctacacacgtgctacaatggcaactacagtgggcagcaacgtcgcgaggcggagctaatctccaaaagttgtctcagttcggattgttctctgcaactcgagagcatgaaggtggaatcgctagtaatcgtagatcagcatgctacggtgaatacgttcccgggccttgtacacaccgcccgtcacaccatgggagttggttctacccgaagccggtgcgctaaccgcaaggaggcagccgaccacggtagggtcagcgactggggtgaagtcgtaacaaggtagccgtaggggaacctgcggctggatcacctcctttctaagg

SEQ ID NO: 4452 - DNA, 741 bp, Kiloniella sp. EL199
  ref <308>: DATABASE ACCESSION NUMBER: NCBI ACCESSION: NZ_OMPU01000005.1
  ref <309>: DATABASE ENTRY DATE: 2019-04-01
  ref <313>: RELEVANT RESIDUES IN SEQ ID NO: (1)..(741)
gccgtaaacgatgtgaactagtcgtcaggatgcttgcatcttggtgacggagctaacgtattaagttcaccgcctggggagtacggtcgcaagattaaaactcaaaggaattgacgggggcccgcacaagcggtggagcatgtggtttaattcgaagcaacgcgcagaaccttaccagcccttgacataccaatcgcggatttcagagatgaattccttcagttcggctggattggatacaggtgctgcatggctgtcgtcagctcgtgtcgtgagatgttgggttaagtcccgcaacgagcgcaacccctgcctttagttgccatcattaagttgggcactctagagggactgccggtgataagccggaggaaggcggggatgacgtcaagtcctcatggcccttatgggctgggctacacacgtgctacaatggcaactacagtgggcagcgaccatgcgagtggaagctaatctccaaaagttgtctcagttcggattgttctctgcaactcgagagcatgaaggtggaatcgctagtaatcgtagatcagcatgctacggtgaatacgttcccgggccttgtacacaccgcccgtcacaccatgggagttggttctacccgaagccggtgcgctaaccgcaaggaggcagccgaccacggtagggtcagcgactggggtgaagtcgtaacaaggtagccgtaggggaacctgcggctggatcacctcctttctaagg

SEQ ID NO: 4453 - DNA, 1507 bp, Kiloniella spongiae
  ref <308>: DATABASE ACCESSION NUMBER: NCBI ACCESSION: NZ_LAQL01000034.1
  ref <309>: DATABASE ENTRY DATE: 2019-04-01
  ref <313>: RELEVANT RESIDUES IN SEQ ID NO: (1)..(1507)
aggtcaacttgagagtttgatcctggctcagaacgaacgctggcggcaggcttaacacatgcaagtcgaacgagaaggttctttcgggaactggacagtggcgcacgggtgagtaacgcgtgggaatctaccatggagtgggggataacagttggaaacgactgctaataccgcatacgccctacgggggaaagatttattgctctatgatgagcccgcgttagattaggtagttggtggggtaatggcctaccaagcctacgatctatagctggtctgagaggatgatcagccacactgggactgagacacggcccagactcctacgggaggcagcagtggggaatattggacaatgggggcaaccctgatccagccatgccgcgtgagtgaagaaggccttagggttgtaaaactctttcaactgtgaggatgatgacagtagcagtagaagaagcaccggctaacttcgtgccagcagccgcggtaatacgaagggtgcgagcgttgttcggaattactgggcgtaaagggcgtgtaggcggattgcaaagatagaggtgaaaggcctgggctcaacctgggaactgcctttataacttgcagtctagagatcgagagaggatagcggaattcctagtgtagaggtgaaattcgtagatattaggaagaacaccagtggcgaaggcggctatctggctcgatactgacgctgaggcgcgaaagcgtggggagcaaacaggattagataccctggtagtccacgccgtaaacgatgtgaactagtcgtcaggatgcttgcatcttggtgacggagctaacgtattaagttcaccgcctggggagtacggtcgcaagattaaaactcaaaggaattgacgggggcccgcacaagcggtggagcatgtggtttaattcgaagcaacgcgcagaaccttaccagcccttgacataccaatcgcggtttccagagatggattccttcagttcggctggattggatacaggtgctgcatggctgtcgtcagctcgtgtcgtgagatgttgggttaagtcccgcaacgagcgcaacccctgcctttagttgccatcattaagttgggcactctagagggactgccggtgataagccggaggaaggcggggatgacgtcaagtcctcatggcccttatgggctgggctacacacgtgctacaatggcaactacagtgggcagcaacgtcgcgaggcggagctaatctccaaaagttgtctcagttcggattgttctctgcaactcgagagcatgaaggtggaatcgctagtaatcgtagatcagcatgctacggtgaatacgttcccgggccttgtacacaccgcccgtcacaccatgggagttggttctacccgaagccggtgcgctaaccgcaaggaggcagccgaccacggtagggtcagcgactggggtgaagtcgtaacaaggtagccgtaggggaacctgcggctggatcacctcctttctaagga

SEQ ID NO: 4454 - DNA, 1539 bp, Kineothrix alysoides
  ref <308>: DATABASE ACCESSION NUMBER: NCBI ACCESSION: NZ_JPNB01000001.1
  ref <309>: DATABASE ENTRY DATE: 2019-04-01
  ref <313>: RELEVANT RESIDUES IN SEQ ID NO: (1)..(1539)
aacatgagagtttgatcctggctcaggatgaacgctggcggcgtgcctaacacatgcaagtcgaacggagtaattaagcggaagtcttcggatggaagcttagctacttagtggcggacgggtgagtaacgcgtgggcaacctgccctgtaccgggggataacacttagaaataggtgctaataccgcataagcgcacggtctcgcatgagacagtgtgaaaaactccggtggtacaggatggacccgcgtctgattagctagttggtggggtagaggcctaccaaggcgacgatcagtagccggcctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcagggcaagtctgaagtgaaagcccggggctcaaccccgggactgctttggaaactgtccagctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgattactaggtgtcgggggctattagaccttcggtgccgcagcaaacgcaataagtaatccacctggggagtacgttcgcaagaatgaaactcaaaggaattgacggggacccgcacaagcggtggagcatgtggtttaattcgaagcaacgcgaagaaccttaccaagtcttgacatcccaatgacagcatatgtaatgtatgttcccttcggggcattggagacaggtggtgcatggttgtcgtcagctcgtgtcgtgagatgttgggttaagtcccgcaacgagcgcaacccttatctttagtagccagcagtaagatgggaactctagagagactgccggggataacccggaggaaggtggggatgacgtcaaatcatcatgccccttatgatttgggctacacacgtgctacaatggcgtgaacagagggaagcgaaggggtgacctggagcaaatcccaaaaaacacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtctgtgacctaacccgcaaggggaggagcagccgaaggcaggtctgataactggggtgaagtcgtaacaaggtagccgtatcggaaggtgcggctggatcacctcctttctaaggaa

SEQ ID NO: 4455 - DNA, 1551 bp, Kingella negevensis
  ref <308>: DATABASE ACCESSION NUMBER: NCBI ACCESSION: NZ_FXUV02000073.1
  ref <309>: DATABASE ENTRY DATE: 2019-04-01
  ref <313>: RELEVANT RESIDUES IN SEQ ID NO: (1)..(1551)
agagattgaacataagagtttgatcctggctcagattgaacgctggcggcatgctttacacatgcaagtcgaacggcagcgaggtagtgcttgcactactgtcggcgagtggcgaacgggtgagtaatatattggaacgtaccgagtaatgggggataactatccgaaaggatagctaataccgcatacgacctgagggtgaaagtgggggatcttcggacctcgcgttattcgagcggccaatatctgattaggtagttggtggggtaagagcctaccaagccgacgatcagtagtgggtcttagaggatgatccgccacactgggactgagacacggcccagactcctacgggaggcagcagtggggaattttggacaatgggcgaaagcctgatccagccatgccgcgtgtctgaagaaggccttcgggttgtaaaggacttttgttagggaagaaaaggttgatgctaatatcattaactgatgacggtacctaaagaataagcaccggctaactacgtgccagcagccgcggtaatacgtagggtgcgagcgttaatcggaattactgggcgtaaagcgagcgcagacggttagttaagcaagatgtgaaatccccgagctcaacttgggaactgcgttttgaactggctagctagagtgtgtcagaggggggtagaattccacgtgtagcagtgaaatgcgtagagatgtggaggaataccgatggcgaaggcagccccctgggataacactgacgttcatgctcgaaagcgtgggtagcaaacaggattagataccctggtagtccacgccctaaacgatgtcaattagctgttgggcaacttgattgcttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaatctcccagagacgggagagtgccttcgggaaccgtaacacaggtgctgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcctcatggcccttatgaccagggcttcacacgtcatacaatggtcggtacagagggtagccaagccgcgaggtggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagcgggggataccagaagtaggtaggataaccgtaaggggtccgcttaccacggtatgcttcgtgactggggtgaagtcgtaacaaggtagccgtaggggaacctgcggctggatcacctcctttcta

SEQ ID NO: 4456 - DNA, 1548 bp, Kingella potus
  ref <308>: DATABASE ACCESSION NUMBER: NCBI ACCESSION: NZ_UGJJ01000003.1
  ref <309>: DATABASE ENTRY DATE: 2019-04-01
  ref <313>: RELEVANT RESIDUES IN SEQ ID NO: (1)..(1548)
attgaacataagagtttgatcctggctcagattgaacgctggcggcatgctttacacatgcaagtcggacggcagcggggtagtgcttgcactactgccggcgagtggcgaacgggtgagtaatgcatcggaacgtaccggataatgggggataactttccgaaaggaaggctaataccgcatattccctgagggggaaagcgggggacctttgggcctcgcgttatccgagcggccgatgtctgattagctagttggtggggtaaaggcctaccaaggcgacgatcagtagcgggtctgagaggacgatccgccacactgggactgagacacggcccagactcctacgggaggcagcagtggggaattttggacaatgggcgcaagcctgatccagccatgccgcgtgtctgaagaaggccttcgggttgtaaaggacttttgttagggaagaaagggtttgtgctaataccatgaacttatgacggtacctgaagaataagcaccggctaactacgtgccagcagccgcggtaatacgtagggtgcgagcgttaatcggaattactgggcgtaaagcgggcgcagacggtttgttaagcaggatgtgaaatccccgggctcaacctgggaactgcgttctgaactggcaggctagagtgtgtcagaggggggtagaattccacgtgtagcagtgaaatgcgtagagatgtggaggaataccgatggcgaaggcagccccctgggataacactgacgttcatgcccgaaagcgtgggtagcaaacaggattagataccctggtagtccacgccctaaacgatgtcgattagctgttgggcaacttgattgcttagtagcgtagctaacgcgtgaaatcgaccgcctggggagtacggtcgcaagattaaaactcaaaggaattgacggggacccgcacaagcggtggatgatgtggattaattcgatgcaacgcgaagaaccttacctggtcttgacatgtacggaaccttccagagacggaagggtgccttcgggagccgtaacacaggtgctgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcctcatggcccttatgaccagggcttcacacgtcatacaatggtcggtacagagggtagccaagccgcgaggcggagccaatcccacaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaagcaggtaggctaaccgcaaggaggccgcttgccacggtatgcttcatgactggggtgaagtcgtaacaaggtagccgtaggggaacctgcggctggatcacctcctttctag

SEQ ID NO: 4457 - DNA, 1522 bp, Kitasatospora cineracea
  ref <308>: DATABASE ACCESSION NUMBER: NCBI ACCESSION: NZ_RJVJ01000001.1
  ref <309>: DATABASE ENTRY DATE: 2019-04-01
  ref <313>: RELEVANT RESIDUES IN SEQ ID NO: (1)..(1522)
cattcacggagagtttgatcctggctcaggacgaacgctggcggcgtgcttaacacatgcaagtcgaacggtgaagcccttcggggtggatcagtggcgaacgggtgagtaacacgtggggaatctgccctgaactctgggacaagccttggaaacgaggtctaataccggatacgaccgtctcccgcatgggggccggtggaaagctccggcggttcaggatgatcccgcggcctatcagcttgttggtggggtaatggcccaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcaccggctaactacgtgccagcagccgcggtaatacgtagggtgcgagcgttgtccggaattattgggcgtaaagagctcgtaggcggcctgtcgcgtcggatgtgaaagcccggggctcaaccccgggtctgcattcgatacgggcaggctggagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtccagagatgggcgcccccttgtggtcggtgtacaggtggtgcatggttgtcgtcagctcgtgtcgtgagatgttgggttaagtcccgcaacgagcgcaacccttgttctgtgttgccagcgagtaatgtcggggactcacaggagactgccggggtcaactcggaggaaggtggggacgacgtcaaatcatcatgccccttatgtcttgggctgcacacgtgctacaatggccggtacaaagggctgcgatgccgcgaggcggagcgaatcccaaaaagccggtctcagttcggattggggtctgcaactcgaccccatgaagttggagttgctagtaatcgcagatcagcatgctgcggtgaatacgttcccgggccttgtacacaccgcccgtcacgtcacgaaagtcggtaacacccgaagccggtggcctaacccgtaaggggaggagccgtcgaaggtgggaccagcgattgggacgaagtcgtaacaaggtagccgtaccggaaggtgcggctggatcacctcctttcta

SEQ ID NO: 4458 - DNA, 1522 bp, Kitasatospora niigatensis
  ref <308>: DATABASE ACCESSION NUMBER: NCBI ACCESSION: NZ_RKQG01000001.1
  ref <309>: DATABASE ENTRY DATE: 2019-04-01
  ref <313>: RELEVANT RESIDUES IN SEQ ID NO: (1)..(1522)
cattcacggagagtttgatcctggctcaggacgaacgctggcggcgtgcttaacacatgcaagtcgaacggtgaagcccttcggggtggatcagtggcgaacgggtgagtaacacgtggggaatctgccctgaactctgggacaagccttggaaacgaggtctaataccggatacgaccgtctcccgcatgggggccggtggaaagctccggcggttcaggatgatcccgcggcctatcagcttgttggtggggtaacggcccaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcaccggctaactacgtgccagcagccgcggtaatacgtagggtgcgagcgttgtccggaattattgggcgtaaagagctcgtaggcggcctgtcgcgtcggatgtgaaagcccggggctcaaccccgggtctgcattcgatacgggcaggctggagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaactggtagagatatcagcccccttgtggtcggtgtacaggtggtgcatggttgtcgtcagctcgtgtcgtgagatgttgggttaagtcccgcaacgagcgcaacccttgttctgtgttgccagcgagtaatgtcggggactcacaggagactgccggggtcaactcggaggaaggtggggacgacgtcaaatcatcatgccccttatgtcttgggctgcacacgtgctacaatggccggtacaaagggctgcgatgccgcgaggcggagcgaatcccaaaaagccggtctcagttcggattggggtctgcaactcgaccccatgaagttggagttgctagtaatcgcagatcagcatgctgcggtgaatacgttcccgggccttgtacacaccgcccgtcacgtcacgaaagtcggtaacacccgaagccggtggcctaacccgtaaggggaggagccgtcgaaggtgggaccagcgattgggacgaagtcgtaacaaggtagccgtaccggaaggtgcggctggatcacctcctttcta

SEQ ID NO: 4459 - DNA, 1550 bp, Klebsiella aerogenes
  ref <308>: DATABASE ACCESSION NUMBER: NCBI ACCESSION: NZ_LR134475.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttagcgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4460 - DNA, 1554 bp, Klebsiella cf. planticola B43
  ref <308>: DATABASE ACCESSION NUMBER: NCBI ACCESSION: NZ_BADH01000751.1
  ref <309>: DATABASE ENTRY DATE: 2019-04-01
  ref <313>: RELEVANT RESIDUES IN SEQ ID NO: (1)..(1554)
ttaaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaaactcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4461 - DNA, 1550 bp, Klebsiella grimontii
  ref <308>: DATABASE ACCESSION NUMBER: NCBI ACCESSION: NZ_FZTC01000044.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 4462 - DNA, 1550 bp, Klebsiella michiganensis
  ref <308>: DATABASE ACCESSION NUMBER: NCBI ACCESSION: NZ_RZJS01000090.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4463 - DNA, 998 bp, Klebsiella michiganensis
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatcca

SEQ ID NO: 4464 - DNA, 1550 bp, Klebsiella oxytoca
  ref <308>: DATABASE ACCESSION NUMBER: NCBI ACCESSION: NZ_LR134333.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataacgtcgcaagaccaaagagggggaccttagggcctcttgccatcggatgtgcccagatgggattagcttgtaggtgaggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtgaggttaataaccttattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatctggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 4465 - DNA, 1551 bp, Klebsiella pneumoniae
  ref <308>: DATABASE ACCESSION NUMBER: NCBI ACCESSION: NZ_LR134202.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggaggggcgcttaccactttgtgattcatgactggggtgaagtcgtaacaaggtaaccgtaggggaacctgcggttggatcacctccttaccttaaagaa

SEQ ID NO: 4466 - DNA, 1550 bp, Klebsiella quasipneumoniae
  ref <308>: DATABASE ACCESSION NUMBER: NCBI ACCESSION: NZ_UTAA01000175.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4467 - DNA, 1550 bp, Klebsiella quasivariicola
  ref <308>: DATABASE ACCESSION NUMBER: NCBI ACCESSION: NZ_UJZG01000055.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcgagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4468 - DNA, 1550 bp, Klebsiella sp. A-Nf5
  ref <308>: DATABASE ACCESSION NUMBER: NCBI ACCESSION: NZ_PIOG01000256.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4469 - DNA, 1078 bp, Klebsiella sp. AA405
  ref <308>: DATABASE ACCESSION NUMBER: NCBI ACCESSION: NZ_LKKX01000048.1
  ref <309>: DATABASE ENTRY DATE: 2019-04-01
  ref <313>: RELEVANT RESIDUES IN SEQ ID NO: (1)..(1078)
tcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4470 - DNA, 1550 bp, Klebsiella sp. B-Nf7; identical to SEQ ID NO: 4468
  ref <308>: DATABASE ACCESSION NUMBER: NCBI ACCESSION: NZ_PIOH01000039.1
  ref <309>: DATABASE ENTRY DATE: 2019-04-01
  ref <313>: RELEVANT RESIDUES IN SEQ ID NO: (1)..(1550)

SEQ ID NO: 4471 - DNA, 1550 bp, Klebsiella sp. C-Nf10
  ref <308>: DATABASE ACCESSION NUMBER: NCBI ACCESSION: NZ_PIOJ01000037.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4472 - DNA, 1550 bp, Klebsiella sp. C1-16S-Nf17; identical to SEQ ID NO: 4468
  ref <308>: DATABASE ACCESSION NUMBER: NCBI ACCESSION: NZ_PIOI01000038.1
  ref <309>: DATABASE ENTRY DATE: 2019-04-01
  ref <313>: RELEVANT RESIDUES IN SEQ ID NO: (1)..(1550)

SEQ ID NO: 4473 - DNA, 1550 bp, Klebsiella sp. C31
  ref <308>: DATABASE ACCESSION NUMBER: NCBI ACCESSION: NZ_QBUZ01000035.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataatgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgataaggttaataaccttggcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4474 - DNA, 1550 bp, Klebsiella sp. D-Nf1; identical to SEQ ID NO: 4471
  ref <308>: DATABASE ACCESSION NUMBER: NCBI ACCESSION: NZ_PIOK01000025.1
  ref <309>: DATABASE ENTRY DATE: 2019-04-01
  ref <313>: RELEVANT RESIDUES IN SEQ ID NO: (1)..(1550)

SEQ ID NO: 4475 - DNA, 758 bp, Klebsiella sp. E-Nf3
  ref <308>: DATABASE ACCESSION NUMBER: NCBI ACCESSION: NZ_PIOL01000108.1
  ref <309>: DATABASE ENTRY DATE: 2019-04-01
  ref <313>: RELEVANT RESIDUES IN SEQ ID NO: (1)..(758)
gtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactt

SEQ ID NO: 4476 - DNA, 1550 bp, Klebsiella sp. F-Nf9
  ref <308>: DATABASE ACCESSION NUMBER: NCBI ACCESSION: NZ_PIOM01000058.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4477 - DNA, 1550 bp, Klebsiella sp. FDAARGOS 511
  ref <308>: DATABASE ACCESSION NUMBER: NCBI ACCESSION: NZ_CP033824.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaggttaataaccttattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4478 - DNA, 1550 bp, Klebsiella sp. G-Nf4
  ref <308>: DATABASE ACCESSION NUMBER: NCBI ACCESSION: NZ_PION01000028.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4479 - DNA, 1550 bp, Klebsiella sp. G2-16S-Nf13; identical to SEQ ID NO: 4478
  ref <308>: DATABASE ACCESSION NUMBER: NCBI ACCESSION: NZ_PIOO01000037.1
  ref <309>: DATABASE ENTRY DATE: 2019-04-01
  ref <313>: RELEVANT RESIDUES IN SEQ ID NO: (1)..(1550)

SEQ ID NO: 4480 - DNA, 201 bp, Klebsiella sp. GL120222-02
  ref <308>: DATABASE ACCESSION NUMBER: NCBI ACCESSION: NZ_QEQO01000013.1
  ref <309>: DATABASE ENTRY DATE: 2019-04-01
  ref <313>: RELEVANT RESIDUES IN SEQ ID NO: (1)..(201)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggg

SEQ ID NO: 4481 - DNA, 1550 bp, Klebsiella sp. H-Nf2
  ref <308>: DATABASE ACCESSION NUMBER: NCBI ACCESSION: NZ_PIBL01000029.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4482 - DNA, 1550 bp, Klebsiella sp. I-Nf8; identical to SEQ ID NO: 4478
  ref <308>: DATABASE ACCESSION NUMBER: NCBI ACCESSION: NZ_PIBM01000025.1
  ref <309>: DATABASE ENTRY DATE: 2019-04-01
  ref <313>: RELEVANT RESIDUES IN SEQ ID NO: (1)..(1550)

SEQ ID NO: 4483 - DNA, 1550 bp, Klebsiella sp. J-Nf11; identical to SEQ ID NO: 4478
  ref <308>: DATABASE ACCESSION NUMBER: NCBI ACCESSION: NZ_PJDI01000025.1
  ref <309>: DATABASE ENTRY DATE: 2019-04-01
  ref <313>: RELEVANT RESIDUES IN SEQ ID NO: (1)..(1550)

SEQ ID NO: 4484 - DNA, 1550 bp, Klebsiella sp. K-Nf6; identical to SEQ ID NO: 4478
  ref <308>: DATABASE ACCESSION NUMBER: NCBI ACCESSION: NZ_PIBN01000043.1
  ref <309>: DATABASE ENTRY DATE: 2019-04-01
  ref <313>: RELEVANT RESIDUES IN SEQ ID NO: (1)..(1550)

SEQ ID NO: 4485 - DNA, 523 bp, Klebsiella sp. KG9
  ref <308>: DATABASE ACCESSION NUMBER: NCBI ACCESSION: NZ_PDFC01000049.1
  ref <309>: DATABASE ENTRY DATE: 2019-04-01
  ref <313>: RELEVANT RESIDUES IN SEQ ID NO: (1)..(523)
attgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatcca

SEQ ID NO: 4486 - DNA, 1439 bp, Klebsiella sp. KGM-IMP216
  ref <308>: DATABASE ACCESSION NUMBER: NCBI ACCESSION: NZ_LJOI01000063.1
  ref <309>: DATABASE ENTRY DATE: 2019-04-01
  ref <313>: RELEVANT RESIDUES IN SEQ ID NO: (1)..(1439)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataaygtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgttaaggttaataaccttgkcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtycggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggta

SEQ ID NO: 4487 - DNA, 1549 bp, Klebsiella sp. Kd70 TUC-EEAOC
  ref <308>: DATABASE ACCESSION NUMBER: NCBI ACCESSION: NZ_LGRU01000035.1
  ref <309>: DATABASE ENTRY DATE: 2019-04-01
  ref <313>: RELEVANT RESIDUES IN SEQ ID NO: (1)..(1549)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaggttaataaccttgtcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 4488 - DNA, 1550 bp, Klebsiella sp. LY
  ref <308>: DATABASE ACCESSION NUMBER: NCBI ACCESSION: NZ_CP022444.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttgccagagatggcttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4489 - DNA, 1554 bp, Klebsiella sp. MBT K-1
  ref <308>: DATABASE ACCESSION NUMBER: NCBI ACCESSION: NZ_PDEL01000036.1
  ref <309>: DATABASE ENTRY DATE: 2019-04-01
  ref <313>: RELEVANT RESIDUES IN SEQ ID NO: (1)..(1554)
acttaaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 4490 - DNA, 213 bp, Klebsiella sp. NFIX25
  ref <308>: DATABASE ACCESSION NUMBER: NCBI ACCESSION: NZ_FNPY01000010.1
  ref <309>: DATABASE ENTRY DATE: 2019-04-01
  ref <313>: RELEVANT RESIDUES IN SEQ ID NO: (1)..(213)
acttaaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcg

SEQ ID NO: 4491 - DNA, 220 bp, Klebsiella sp. NFIX34
  ref <308>: DATABASE ACCESSION NUMBER: NCBI ACCESSION: NZ_FNRN01000011.1
  ref <309>: DATABASE ENTRY DATE: 2019-04-01
  ref <313>: RELEVANT RESIDUES IN SEQ ID NO: (1)..(220)
acttaaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctca

SEQ ID NO: 4492 - DNA, 209 bp, Klebsiella sp. NFIX35
  ref <308>: DATABASE ACCESSION NUMBER: NCBI ACCESSION: NZ_FOUW01000012.1
  ref <309>: DATABASE ENTRY DATE: 2019-04-01
  ref <313>: RELEVANT RESIDUES IN SEQ ID NO: (1)..(209)
acttaaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggacc

SEQ ID NO: 4493 - DNA, 208 bp, Klebsiella sp. NFIX40
  ref <308>: DATABASE ACCESSION NUMBER: NCBI ACCESSION: NZ_FMUM01000010.1
  ref <309>: DATABASE ENTRY DATE: 2019-04-01
  ref <313>: RELEVANT RESIDUES IN SEQ ID NO: (1)..(208)
acttaaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggac

SEQ ID NO: 4494 - DNA, 215 bp, Klebsiella sp. NFIX42
  ref <308>: DATABASE ACCESSION NUMBER: NCBI ACCESSION: NZ_FMVG01000011.1
  ref <309>: DATABASE ENTRY DATE: 2019-04-01
  ref <313>: RELEVANT RESIDUES IN SEQ ID NO: (1)..(215)
acttaaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcggg

SEQ ID NO: 4495 - DNA, 261 bp, Klebsiella sp. NFIX53
  ref <308>: DATABASE ACCESSION NUMBER: NCBI ACCESSION: NZ_QKUD01000015.1
  ref <309>: DATABASE ENTRY DATE: 2019-04-01
  ref <313>: RELEVANT RESIDUES IN SEQ ID NO: (1)..(261)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaa

SEQ ID NO: 4496 - DNA, 1551 bp, Klebsiella sp. P1CD1
  ref <308>: DATABASE ACCESSION NUMBER: NCBI ACCESSION: NZ_CP033631.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacaatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctggtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4497 - DNA, 1554 bp, Klebsiella sp. PO552
  ref <308>: DATABASE ACCESSION NUMBER: NCBI ACCESSION: NZ_NFVM01000025.1
  ref <309>: DATABASE ENTRY DATE: 2019-04-01
  ref <313>: RELEVANT RESIDUES IN SEQ ID NO: (1)..(1554)
acttaaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4498 - DNA, 1327 bp, Klebsiella sp. T11
  ref <308>: DATABASE ACCESSION NUMBER: NCBI ACCESSION: NZ_PJDJ01000156.1
  ref <309>: DATABASE ENTRY DATE: 2019-04-01
  ref <313>: RELEVANT RESIDUES IN SEQ ID NO: (1)..(1327)
ggacgggtgagtaatgtctgggaaactgcctgatggagggggataactactggaaacggtagctaataccgcataacgtcgcaagaccaaagtgggggaccttcgggcctcatgccatcagatgtgcccagatgggattagctggtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaaga

SEQ ID NO: 4499 - DNA, 1093 bp, Klebsiella sp. WCHKl090001
  ref <308>: DATABASE ACCESSION NUMBER: NCBI ACCESSION: NZ_QAJT01000097.1
  ref <309>: DATABASE ENTRY DATE: 2019-04-01
  ref <313>: RELEVANT RESIDUES IN SEQ ID NO: (1)..(1093)
tggttaataaccattttcattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaacttgccagagatggcttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4500 - DNA, 1550 bp, Klebsiella sp. WCHKl090539; identical to SEQ ID NO: 4477
  ref <308>: DATABASE ACCESSION NUMBER: NCBI ACCESSION: NZ_QBFI01000037.1
  ref <309>: DATABASE ENTRY DATE: 2019-04-01
  ref <313>: RELEVANT RESIDUES IN SEQ ID NO: (1)..(1550)

SEQ ID NO: 4501 - DNA, 533 bp, Klebsiella sp. X1-16S-Nf21
  ref <308>: DATABASE ACCESSION NUMBER: NCBI ACCESSION: NZ_PJDK01000171.1
  ref <309>: DATABASE ENTRY DATE: 2019-04-01
  ref <313>: RELEVANT RESIDUES IN SEQ ID NO: (1)..(533)
cgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactt

SEQ ID NO: 4502 - DNA, 1557 bp, Klebsiella variicola
  ref <308>: DATABASE ACCESSION NUMBER: NCBI ACCESSION: NZ_LR130544.1
  ref <309>: DATABASE ENTRY DATE: 2019-04-01
  ref <313>: RELEVANT RESIDUES IN SEQ ID NO: (1)..(1557)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctggtaggtggggtaacggctcacctaggcgacgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtgggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4503 - DNA, 1550 bp, Kluyvera georgiana
  ref <308>: DATABASE ACCESSION NUMBER: NCBI ACCESSION: NZ_LSME01000067.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccacagcgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgttcccttgaggagtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4504 - DNA, 1553 bp, Kluyvera intermedia
  ref <308>: DATABASE ACCESSION NUMBER: NCBI ACCESSION: NZ_LR134138.1
  ref <309>: DATABASE ENTRY DATE: 2019-04-01
  ref <313>: RELEVANT RESIDUES IN SEQ ID NO: (1)..(1553)
aaattgaagagtttgatcatggctcagattgaacgctggcggcaggcctaacacatgcaagtcgaacggtagcacagagagcttgctcttgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccgcagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggcccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggattcacctccttaccttaaagaa

SEQ ID NO: 4505 - DNA, 1550 bp, Kluyvera sp. Nf5
  ref <308>: DATABASE ACCESSION NUMBER: NCBI ACCESSION: NZ_PYTY01000088.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagcttgttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4506 - DNA, 1539 bp, Kocuria carniphila
  ref <308>: DATABASE ACCESSION NUMBER: NCBI ACCESSION: NZ_NOIT01000037.1
  ref <309>: DATABASE ENTRY DATE: 2019-04-01
  ref <313>: RELEVANT RESIDUES IN SEQ ID NO: (1)..(1539)
ttgacggagagtttgatcctggctcaggacgaacgctggcggcgtgcttaacacatgcaagtcgaacgctgaagcttgggtgcttgcatctgggtggatgagtggcgaacgggtgagtaatacgtgagtaacctgcccttgactctgggataagcctgggaaactgggtctaatactggatactacactctctcgcatgggggggtgtggaaagggttttactggttttggatgggctcacggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcacggaagaagcgaaagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgtggtgtgcagtgggtacgggcagactagagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccagaccggcccagagatgggttttcctctttgaggttggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaatgggttgcgataccgtgaggtggagctaatcccaaaaagctggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggactaagtcgtaacaaggtagccgtaccggaaggtgcggctggatcacctcctttctaagga

SEQ ID NO: 4507 - DNA, 1542 bp, Kocuria halotolerans
  ref <308>: DATABASE ACCESSION NUMBER: NCBI ACCESSION: NZ_NOIU01000008.1
  ref <309>: DATABASE ENTRY DATE: 2019-04-01
  ref <313>: RELEVANT RESIDUES IN SEQ ID NO: (1)..(1542)
ttgtaacggagagtttgatcctggctcaggacgaacgctggcggcgtgcttaacacatgcaagtcgaacgctgaagcacccagcttgctgggtgtggatgagtggcgaacgggtgagtaatacgtgagtgaccttcccttgactctgggataagcccgggaaactgggtctaataccggatatgcactatcacctgcctgggtggtggtggaaagggttttgtactggtcttggatgggctcacggcctatcagctagttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtctgctgtgaaagcccggggcttaaccccgtggtgtgcagtgggtacgggcaggctagagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacactggatcgcagcagagatgttgtttcctctttgaggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaacccttgtggagggagtcgtcgaaggtgggactggcgattgggactaagtcgtaacaaggtagccgtaccggaaggtgcggctggatcacctcctttctaagga

SEQ ID NO: 4508 - DNA, 1539 bp, Kocuria koreensis
  ref <308>: DATABASE ACCESSION NUMBER: NCBI ACCESSION: NZ_NOIQ01000043.1
  ref <309>: DATABASE ENTRY DATE: 2019-04-01
  ref <313>: RELEVANT RESIDUES IN SEQ ID NO: (1)..(1539)
ttttaacggagagtttgatcctggctcaggacgaacgctggcggcgtgcttaacacatgcaagtcgaacgctgaagctgggtgcttgcacctggtggatgagtggcgaacgggtgagtaatacgtgagtgaccttccttggactctgggataagcccgggaaactgggtctaataccggatacgaccagtcctcgcatggggtgctggtggaaagggtttgtactggttcttgatgggctcacgtcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgggggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggctcaaccccgggtgtgcagtgggtacgggcaggctggagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggatcgcagcagagatgttgtttcccttcggggctggtgtacaggtggtgcatggttgtcgtcagctcgtgtcgtgagatgttgggttaagtcccgcaacgagcgcaaccctcgttctatgttgccagcacgttgtggtggggactcataggagactgccggggtcaactcggaggaaggtggggatgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcccaacccttgtggggggagtcgtcgaaggtgggactggcgattgggactaagtcgtaacaaggtagccgtaccggaaggtgcggctggatcacctcctttctaagga

SEQ ID NO: 4509 - DNA, 1538 bp, Kocuria rhizophila
  ref <308>: DATABASE ACCESSION NUMBER: NCBI ACCESSION: NZ_LR134409.1
  ref <309>: DATABASE ENTRY DATE: 2019-04-01
  ref <313>: RELEVANT RESIDUES IN SEQ ID NO: (1)..(1538)
ttgacggagagtttgatcctggctcaggacgaacgctggcggcgtgcttaacacatgcaagtcgaacgctgaagcttggtgcttgcactgggtggatgagtggcgaacgggtgagtaatacgtgagtaacctgcccttgactctgggataagcctgggaaactgggtctaatactggatacgacggcgcatcgcatggtgtgttgtggaaagggttttactggttttggatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagcacggaagaagcgagagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtggggaacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaccgggccagagatggtctttcccccttgtggggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccagtacaatgggttgcgatgccgtgaggtggagctaatcccaaaaagctggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggactaagtcgtaacaaggtagccgtaccggaaggtgcggctggatcacctcctttctaagga

SEQ ID NO: 4510 - DNA, 1533 bp, Kocuria rosea
  ref <308>: DATABASE ACCESSION NUMBER: NCBI ACCESSION: NZ_LR134487.1
  ref <309>: DATABASE ENTRY DATE: 2019-04-01
  ref <313>: RELEVANT RESIDUES IN SEQ ID NO: (1)..(1533)
ttgacggagagtttgatcctggctcaggacgaacgctggcggcgtgcttaacacatgcaagtcgaacgatgatgcccagcttgctgggcggattagtggcgaacgggtgagtaatacgtgagtaacctgcccttgactctgggataagcctgggaaactgggtctaatactggatactacctcttaccgcatggtgggtggtggaaagggttttactggttttggatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagtagggaagaagcgagagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggctcaaccccgggtctgcagtgggtacgggcagactagagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacattcaccggaccgccccagagatggggtttcccttcggggctggtggacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaaagggttgcgatactgtgaggtggagctaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagccgtcgaaggtgggactggcgattgggactaagtcgtaacaaggtagccgtaccggaaggtgcggctggatcacctcctttctaagga

SEQ ID NO: 4511 - DNA, 1540 bp, Kocuria sp. 257
  ref <308>: DATABASE ACCESSION NUMBER: NCBI ACCESSION: NZ_NOIR01000006.1
  ref <309>: DATABASE ENTRY DATE: 2019-04-01
  ref <313>: RELEVANT RESIDUES IN SEQ ID NO: (1)..(1540)
ttttaacggagagtttgatcctggctcaggacgaacgctggcggcgtgcttaacacatgcaagtcgaacgctgaagcctggtgcttgcactgggtggatgagtggcgaacgggtgagtaatacgtgagtgaccttccttgaactctgggataagcccgggaaactgggtctaataccggatacgaccagtcctcgcatggggtgctggtggaaagggtttgtactggttcttgatgggctcacgtcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggctcaaccccgggtgtgcagtgggtacgggcaggctagagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacactggatcgccgtagagatacggtttcccttcggggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccctttgtggggggaatcgtcgaaggtgggactggcgattgggactaagtcgtaacaaggtagccgtaccggaaggtgcggctggatcacctcctttctaagga

SEQ ID NO: 4512 - DNA, 1540 bp, Kocuria sp. 36
  ref <308>: DATABASE ACCESSION NUMBER: NCBI ACCESSION: NZ_NOIS01000008.1
  ref <309>: DATABASE ENTRY DATE: 2019-04-01
  ref <313>: RELEVANT RESIDUES IN SEQ ID NO: (1)..(1540)
ttttaacggagagtttgatcctggctcaggacgaacgctggcggcgtgcttaacacatgcaagtcgaacgctgaagcctggtgcttgcactgggtggatgagtggcgaacgggtgagtaatacgtgagtgaccttccttgaactctgggataagcccgggaaactgggtctaataccggatacgaccagtcctcgcatggggtgctggtggaaagggtttgtactggttcttgatgggctcacgtcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggctcaaccccgggtgtgcagtgggtacgggcaggctagagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacactggatcgccgtagagatacggtttcccttcggggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaaccctttgtggggggagtcgtcgaaggtgggactggcgattgggactaagtcgtaacaaggtagccgtaccggaaggtgcggctggatcacctcctttctaagga

SEQ ID NO: 4513 - DNA, 1538 bp, Kocuria sp. 442
  ref <308>: DATABASE ACCESSION NUMBER: NCBI ACCESSION: NZ_PNJG02000008.1
  ref <309>: DATABASE ENTRY DATE: 2019-04-01
  ref <313>: RELEVANT RESIDUES IN SEQ ID NO: (1)..(1538)
ttgacggagagtttgatcctggctcaggacgaacgctggcggcgtgcttaacacatgcaagtcgaacgctgaaaccgggtgcttgcactgggtggatgagtggcgaacgggtgagtaatacgtgagtaacctgcccttgactctgggataagcctgggaaactgggtctaatactggatacgacatgtcatcgcatggtggtgtgtggaaagggttttactggttttggatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcacggaagaagcgaaagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtggggaacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaccgggccagagatggtctttcccccttgtggggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccagtacaatgggttgcgatgccgtgaggtggagctaatcccaaaaagctggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggactaagtcgtaacaaggtagccgtaccggaaggtgcggctggatcacctcctttctaagga

SEQ ID NO: 4514 - DNA, 1025 bp, Kocuria sp. CPCC 104605
  ref <308>: DATABASE ACCESSION NUMBER: NCBI ACCESSION: NZ_QPKL01000086.1
  ref <309>: DATABASE ENTRY DATE: 2019-04-01
  ref <313>: RELEVANT RESIDUES IN SEQ ID NO: (1)..(1025)
ttgacggagagtttgatcctggctcaggacgaacgctggcggcgtgcttaacacatgcaagtcgaacgctgaagccccagcttgctggggtggatgagtggcgaacgggtgagtaatacgtgagtgacctgcccttgactctgggataagcctgggaaactgggtctaatactggatacgacagtacatcgcatggtgtgttgtggaaagggtttgtactggttttggatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtctgcagtgggtacgggcagactagagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccagaccgtcccagagatgggatttccactttgtggttggtg

SEQ ID NO: 4515 - DNA, 1540 bp, Kocuria sp. HSID16901
  ref <308>: DATABASE ACCESSION NUMBER: NCBI ACCESSION: NZ_RBLM01000015.1
  ref <309>: DATABASE ENTRY DATE: 2019-04-01
  ref <313>: RELEVANT RESIDUES IN SEQ ID NO: (1)..(1540)
ttttaacggagagtttgatcctggctcaggacgaacgctggcggcgtgcttaacacatgcaagtcgaacgctgaagcttggtgcttgcaccgggtggatgagtggcgaacgggtgagtaatacgtgagtgacctaccttggactctgggataagcctgggaaactgggtctaataccggatatgaccaatgggcgcatgctctgttggtggaaagggtttgtactggtctttgatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcaggctagagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggatcgcagcagagatgttgtttcctttcggggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccgatggcctaaccctttgtggggggagtcgtcgaaggtgggactggcgattgggactaagtcgtaacaaggtagccgtaccggaaggtgcggctggatcacctcctttctaagga

SEQ ID NO: 4516 - DNA, 1539 bp, Kocuria sp. HSID17582
  ref <308>: DATABASE ACCESSION NUMBER: NCBI ACCESSION: NZ_RBMA01000176.1
  ref <309>: DATABASE ENTRY DATE: 2019-04-01
  ref <313>: RELEVANT RESIDUES IN SEQ ID NO: (1)..(1539)
ttgacggagagtttgatcctggctcaggacgaacgctggcggcgtgcttaacacatgcaagtcgaacgctgaagcttggtgcttgcactgggtggatgagtggcgaacgggtgagtaatacgtgagtaacctgcccttgactctgggataagcctgggaaactgggtctaatactggatacgacatgtcactgcatggtggtgtgtggaaagggttttactggttttggatgggctcacggcctatcagcttgttggtggggtaatggcctaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagcacggaagaagcgagagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaattcctggtgtagcggtgaaatgcgcagatatcaggaagaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaccggttcagagatgttccttcccccttgtggggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaatgggttgcgataccgtgaggtggagctaatcccaaaaagccggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtgggagggagccgtcgaaggtgggactggcgattgggactaagtcgtaacaaggtagccgtaccggaaggtgcggctggatcacctcctttctaagga

SEQ ID NO: 4517 - DNA, 1539 bp, Kocuria sp. HSID17590; identical to SEQ ID NO: 4516
  ref <308>: DATABASE ACCESSION NUMBER: NCBI ACCESSION: NZ_RBMB01000063.1
  ref <309>: DATABASE ENTRY DATE: 2019-04-01
  ref <313>: RELEVANT RESIDUES IN SEQ ID NO: (1)..(1539)

SEQ ID NO: 4518 - DNA, 1544 bp, Kocuria sp. M5W7-7
  ref <308>: DATABASE ACCESSION NUMBER: NCBI ACCESSION: NZ_RKMF01000028.1
  ref <309>: DATABASE ENTRY DATE: 2019-04-01
  ref <313>: RELEVANT RESIDUES IN SEQ ID NO: (1)..(1544)
tttgacggagagtttgatcctggctcaggacgaacgctggcggcgtgcttaacacatgcaagtcgaacgatgaagcggtgcttgcaccgtggattagtggcgaacgggtgagtaatacgtgagtgacctgcccttgactctgggataagcctgggaaactgggtctaatactggatacgaccatcagatgcatgtcttggtggtggaaagggtttgtactggttttggatgggctcacggcctatcagcttgttggtggggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcttttgtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaactccgggtgtgcagtgggtacgggcagactagagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtggggggcattccacgttctccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccagatcgttccagagatggttcttcccttttgggttggtgtacaggtggtgcatggttgtcgtcagctcgtgtcgtgagatgttgggttaagtcccgcaacgagcgcaaccctcgttccatgttgccagcacgctccctttgggggtggtggggactcatgggagactgccggggtcaactcggaggaaggtggggatgacgtcaaatcatcatgccccttatgtcttgggcttcacgcatgctacaatggccggtacaaagggttgcgatactgtgaggtggagctaatcccaaaaagccggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggacgagcgattgggactaagtcgtaacaaggtagccgtaccggaaggtgcggctggatcacctcctttctaagga

SEQ ID NO: 4519 - DNA, 1538 bp, Kocuria sp. OV113
  ref <308>: DATABASE ACCESSION NUMBER: NCBI ACCESSION: NZ_RCCM01000003.1
  ref <309>: DATABASE ENTRY DATE: 2019-04-01
  ref <313>: RELEVANT RESIDUES IN SEQ ID NO: (1)..(1538)
ttgacggagagtttgatcctggctcaggacgaacgctggcggcgtgcttaacacatgcaagtcgaacgctgaagcttggtgcttgcactgggtggatgagtggcgaacgggtgagtaatacgtgagtaacctgcccttgactctgggataagcctgggaaactgggtctaatactggatacgacatgtcaccgcatggtggtgtgtggaaagggttttactggttttggatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagcacggaagaagcgaaagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtggggaacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaccgggccagagatggtctttcccccttgtggggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccagtacaatgggttgcgatgccgcgaggtggagctaatcccaaaaagctggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggactaagtcgtaacaaggtagccgtaccggaaggtgcggctggatcacctcctttctaagga

SEQ ID NO: 4520 - DNA, 1538 bp, Kocuria sp. PT10; identical to SEQ ID NO: 4519
  ref <308>: DATABASE ACCESSION NUMBER: NCBI ACCESSION: NZ_UTAC01000035.1
  ref <309>: DATABASE ENTRY DATE: 2019-04-01
  ref <313>: RELEVANT RESIDUES IN SEQ ID NO: (1)..(1538)

SEQ ID NO: 4521 - DNA, 1538 bp, Kocuria tytonicola
  ref <308>: DATABASE ACCESSION NUMBER: NCBI ACCESSION: NZ_PHOA01000099.1
  ref <309>: DATABASE ENTRY DATE: 2019-04-01
  ref <313>: RELEVANT RESIDUES IN SEQ ID NO: (1)..(1538)
ttgacggagagtttgatcctggctcaggacgaacgctggcggcgtgcttaacacatgcaagtcgaacgctgaagcttggtgcttgcactgggtggatgagtggcgaacgggtgagtaatacgtgagtaacctgcccttgactctgggataagcctgggaaactgggtctaatactggatatgacagtgcatcgcatggtgtgttgtggaaagggttttactggttttggatgggctcacggcctatcagcttgttggtggggtaatggctcaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagcacggaagaagcgaaagtgacggtacgtgcagaagaagcgccggctaactacgtgccagcagccgcggtaatacgtagggcgcaagcgttgtccggaattattgggcgtaaagagctcgtaggcggtttgtcgcgtctgctgtgaaagcccggggcttaaccccgggtgtgcagtgggtacgggcagacttgagtgcagtaggggagactggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtggggaacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaccgggccagagatggtctttcccccttgtggggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccagtacaatgggttgcgataccgtgaggtggagctaatcccaaaaagctggtctcagttcggatcgtggtctgcaactcgaccacgtgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggactaagtcgtaacaaggtagccgtaccggaaggtgcggctggatcacctcctttctaagga

SEQ ID NO: 4522 - DNA, 1495 bp, Komagataeibacter cocois
  ref <308>: DATABASE ACCESSION NUMBER: NCBI ACCESSION: NZ_QEXL01000039.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacccttcggggttagtggcggacgggtgagtaacgcgtagggatctgtccatgggtgggggataaccttgggaaaccgaggctaataccgcatgacacctgagggtcaaaggcgcaagtcgcctgtggaggaacctgcgttcgattagctagttggttgggtaaaggctgaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgttacagtcagatgtgaaattcccgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtggcttggccattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccagcacgtctgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagcggatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4523 - DNA, 1495 bp, Komagataeibacter europaeus
  ref <308>: DATABASE ACCESSION NUMBER: NCBI ACCESSION: NZ_CP021467.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgacacagtcagatgtgaaattcctgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtctgggtgggcactctaaaggaactgccggtgacaagccggaggaaggtggggatgacgtcaagtcctcatggcccttatgtcctgggctacacacgtgctacaatggcggtgacagtgggaagccaggtagcgataccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4524 - DNA, 1495 bp, Komagataeibacter hansenii
  ref <308>: DATABASE ACCESSION NUMBER: NCBI ACCESSION: NZ_MDVY01000014.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcgagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgttacagtcagatgtgaaattcccgggcttaacctgggggctgcatttgatacgtgacgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttggatggcttggccattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccaggacttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccagcacgtctgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagcggatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4525 - DNA, 1495 bp, Komagataeibacter intermedius
  ref <308>: DATABASE ACCESSION NUMBER: NCBI ACCESSION: NZ_BANF01000022.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacctttcggggttagtggcggacgggtgagtaacgcgtagggatctatccacgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgacacagtcagatgtgaaattcccgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtttgggtgggcactctaaaggaactgccggtgacaagccggaggaaggtggggatgacgtcaagtcctcatggcccttatgtcctgggctacacacgtgctacaatggcggtgacagtgggaagccaggtggtgacaccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4526 - DNA, 1495 bp, Komagataeibacter maltaceti
  ref <308>: DATABASE ACCESSION NUMBER: NCBI ACCESSION: NZ_NKUE01000064.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacctttcggggttagtggcggacgggtgagtaacgcgtagggatctgtccatgggtgggggataaccttgggaaaccgaggctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgttacagtcagatgtgaaattcccgggcttaacctgggggctgcatttgatacgtgacgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtggcttggccattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccagcacgtctgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagcggatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4527 - DNA, 1497 bp, Komagataeibacter medellinensis
  ref <308>: DATABASE ACCESSION NUMBER: NCBI ACCESSION: NC_016027.1
  ref <309>: DATABASE ENTRY DATE: 2019-04-01
  ref <313>: RELEVANT RESIDUES IN SEQ ID NO: (1)..(1497)
atgaacctgagagtttgatcctggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgacacagtcaggtgtgaaattcccgggcttaacctggggtctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtttgggtgggcactctaaaggaactgccggtgacaagccggaggaaggtggggatgacgtcaagtcctcatggcccttatgtcctgggctacacacgtgctacaatggcggtgacagtgggaagccaggtggtgacaccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaag

SEQ ID NO: 4528 - DNA, 1497 bp, Komagataeibacter nataicola
  ref <308>: DATABASE ACCESSION NUMBER: NCBI ACCESSION: NZ_NIRT01000069.1
  ref <309>: DATABASE ENTRY DATE: 2019-04-01
  ref <313>: RELEVANT RESIDUES IN SEQ ID NO: (1)..(1497)
atgaacctgagagtttgatcctggctcagagcgaacgctggcggcatgcttaacacatgcaagtcgcacgaacctttcggggttagtggcggacgggtgagtaacgcgtagggatctgtccacgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgacacagtcagatgtgaaattcctgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtctgggtgggcactctaaaggaactgccggtgacaagccggaggaaggtggggatgacgtcaagtcctcatggcccttatgtcctgggctacacacgtgctacaatggcggtgacagtgggaagccaggtagcgataccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaag

SEQ ID NO: 4529 - DNA, 1495 bp, Komagataeibacter oboediens
  ref <308>: DATABASE ACCESSION NUMBER: NCBI ACCESSION: NZ_NKTX01000109.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacctttcggggttagtggcggacgggtgagtaacgcgtagggatctatccacgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggatgatgatgacggtacccgcagaagaagccccggctaacttcgtgccagcagccgcggtaatacgaagggggcaagcgttgctcggaatgactgggcgtaaagggcgcgtaggcggttgacacagtcagatgtgaaattcccgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtctgggtgggcactctaaaggaactgccggtgacaagccggaggaaggtggggatgacgtcaagtcctcatggcccttatgtcctgggctacacacgtgctacaatggcggtgacagtgggaagccaggtggtgacaccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4530 - DNA, 1495 bp, Komagataeibacter pomaceti
  ref <308>: DATABASE ACCESSION NUMBER: NCBI ACCESSION: NZ_NOXG01000056.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacctttcggggttagtggcggacgggtgagtaacgcgtagggatctgtccatgggtgggggataaccttgggaaaccgaggctaataccgcatgacacctgagggtcaaaggcgcaagtcgcctgtggaggaacctgcgttcgattagctagttggttgggtaaaggctgaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgttacagtcagatgtgaaattcccgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtggcttggccattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggctgtgtccagagatgggcatttctcgcaagagacctccagcacaggtgctgcatggctgtcgtcagctcgtgtcgtgagatgttgggttaagtcccgcaacgagcgcaaccctcgcctttagttgccagcacgtctgggtgggcactctaaaggaactgccggtgacaagccggaggaaggtggggatgacgtcaagtcctcatggcccttatgtcctgggctacacacgtgctacaatggcggtgacagtgggaagccaggcagcgatgccgagcggatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4531 - DNA, 1495 bp, Komagataeibacter rhaeticus; identical to SEQ ID NO: 4101
  ref <308>: DATABASE ACCESSION NUMBER: NCBI ACCESSION: NZ_LT575493.1
  ref <309>: DATABASE ENTRY DATE: 2019-04-01
  ref <313>: RELEVANT RESIDUES IN SEQ ID NO: (1)..(1495)

SEQ ID NO: 4532 - DNA, 1495 bp, Komagataeibacter saccharivorans
  ref <308>: DATABASE ACCESSION NUMBER: NCBI ACCESSION: NZ_CP023036.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacctttcggggttagtggcggacgggtgagtaacgcgtagggatctgtccatgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttttaacagtcagatgtgaaattcctgggcttaacctgggggctgcatttgatacgttgagactagagtgtgagagagggttgtggaattcccagtgtagaggtgaaattcgtagatattgggaagaacaccggtggcgaaggcggcaacctggctcattactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtttgggtgggcactctagaggaactgccggtgacaagccggaggaaggtggggatgacgtcaagtcctcatggcccttatgtcctgggctacacacgtgctacaatggcggtgacagtgggaagccaggtagcgataccgagccgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4533 - DNA, 1495 bp, Komagataeibacter sp. AV 382
  ref <308>: DATABASE ACCESSION NUMBER: NCBI ACCESSION: NZ_QUWV01000019.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacctttcggggttagtggcggacgggtgagtaacgcgtagggatctatccacgggtgggggataactttgggaaactgaagctaataccgcatgatacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgtaacagtcagatgtgaaattcctgggcttaacctgggggctgcatttgatacgttgcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccatcacgtctgggtgggcactctaaaggaactgccggtgacaagccggaggaaggtggggatgacgtcaagtcctcatggcccttatgtcctgggctacacacgtgctacaatggcggtgacagtgggaagccaggtagcgataccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4534 - DNA, 1495 bp, Komagataeibacter sucrofermentans
  ref <308>: DATABASE ACCESSION NUMBER: NCBI ACCESSION: NZ_NKUA01000050.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacgaacctttcgaggttagtggcggacgggtgagtaacgcgtagggatctgtccacgggtgggggataactttgggaaactgaagctaataccgcatgacacctgagggtcaaaggcgcaagtcgcctgtggaggaacctgcgttcgattagctagttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggttttcggattgtaaagcactttcagcggggacgatgatgacggtacccgcagaagaagccccggctaacttcgtgccagcagccgcggtaatacgaagggggcaagcgttgctcggaatgactgggcgtaaagggcgcgtaggcggttgacacagtcagatgtgaaattcctgggcttaacctgggggctgcatttgatacgtggcgactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggtgactttgtcattcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgcggaggccgtgtccagagatgggcatttctcgcaagagacctccagcacaggtgctgcatggctgtcgtcagctcgtgtcgtgagatgttgggttaagtcccgcaacgagcgcaaccctcgcctttagttgccagcacgtctgggtgggcactctaaaggaactgccggtgacaagccggaggaaggtggggatgacgtcaagtcctcatggcccttatgtcctgggctacacacgtgctacaatggcggtgacagtgggaagccaggtagcgataccgagccgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 4535 - DNA, 1495 bp, Komagataeibacter swingsii; identical to SEQ ID NO: 4523
  ref <308>: DATABASE ACCESSION NUMBER: NCBI ACCESSION: NZ_NKUB01000060.1
  ref <309>: DATABASE ENTRY DATE: 2019-04-01
  ref <313>: RELEVANT RESIDUES IN SEQ ID NO: (1)..(1495)

SEQ ID NO: 4536 - DNA, 1495 bp, Komagataeibacter xylinus; identical to SEQ ID NO: 4524
  ref <308>: DATABASE ACCESSION NUMBER: NCBI ACCESSION: NZ_FBVP01000001.1
  ref <309>: DATABASE ENTRY DATE: 2019-04-01
  ref <313>: RELEVANT RESIDUES IN SEQ ID NO: (1)..(1495)

SEQ ID NO: 4537 - DNA, 1506 bp, Kordiimonas lacus
  ref <308>: DATABASE ACCESSION NUMBER: NCBI ACCESSION: NZ_FNAK01000005.1
  ref <309>: DATABASE ENTRY DATE: 2019-04-01
  ref <313>: RELEVANT RESIDUES IN SEQ ID NO: (1)..(1506)
ttcaacttgagagtttgatcctggctcagaacgaacgctggcggcacgcctaacacatgcaagtcgaacgcgaacgcaccttcgggtgttattagagtggcggacgggtgagtaacacgtgggaatatgcctttcggtagagaacaacgcttggaaacgagtgctaatactctatacgccctatgggggaaagatttatcgccgaaagattggcccgcgctagattagctagttggtaaggtaatggcttaccaaggcgacgatctatagctggtttgagaggatgatcagccacactgggactgagacacggcccagactcctacgggaggcagcagtggggaatattggacaatgggggcaaccctgatccagcgatgccgcgtgagtgatgaaggccttagggttgtaaaactctttcagtagggaagataatgacggtacctacagaagaagctccggctaactccgtgccagcagccgcggtaatacggagggagctagcgttgttcggaattactgggcgtaaagcgcgcgtaggcggcttagcaagttgggggtgaaatcccggggctcaacctcggaactgcctccaaaactgctaagctagaatcctggagaggtgagtggaattcctagtgtagaggtgaaattcgtagatattaggaagaacaccagtggcgaaggcgactcactggacaggtattgacgctgaggtgcgaaagcgtggggagcgaacaggattagataccctggtagtccacgccgtaaacgatggatgctaggtgttgggtagcttgctattcagtgccgaagctaacgcgttaagcatcccgcctggggagtacggtcgcaagattaaaactcaaaggaattgacgggggcccgcacaagcggtggagcatgtggtttaattcgaagcaacgcgcagaaccttaccagcccttgacataccaatcgcgatttccggagacggatttcttcagttcggctggattggatacaggtgctgcatggctgtcgtcagctcgtgtcgtgagatgttgggttaagtcccgcaacgagcgcaaccctcgcctttagttgccatcatttagttgggcactctagaggaactgccggtgataagccggaggaaggtggggatgacgtcaagtcctcatggcccttatgggctgggctacacacgtgctacaatggcggtgacagagagctgctacctagcgatagggtgctaatctctaaaagccgtctcagttcggattgttctctgcaactcgagagcatgaagttggaatcgctagtaatcgcagatcagcatgctgcggtgaatacgttcccgggccttgtacacaccgcccgtcacaccatgggagttggttttacctgacgccggtgggctaaccttttggaggcagccgaccacggtagagtcagcgactggggtgaagtcgtaacaaggtagccgtaggggaacctgcggctggatcacctcctttctaagga

SEQ ID NO: 4538 - DNA, 1506 bp, Kordiimonas lipolytica
  ref <308>: DATABASE ACCESSION NUMBER: NCBI ACCESSION: NZ_LRUB01000032.1
  ref <309>: DATABASE ENTRY DATE: 2019-04-01
  ref <313>: RELEVANT RESIDUES IN SEQ ID NO: (1)..(1506)
ttcaacttgagagtttgatcctggctcagaacgaacgctggcggcacgcctaacacatgcaagtcgaacgcgaacgcaccttcgggtgttattagagtggcggacgggtgagtaacacgtgggaatatgcctttcggtaaggaacaacgcttggaaacgagtgctaataccttatacgccctgagggggaaagatttatcgccgaaagattggcccgcgttagattagctagttggtgaggtaatggctcaccaaggcgacgatctatagctggtttgagaggatgatcagccacactgggactgagacacggcccagactcctacgggaggcagcagtggggaatattggacaatgggggcaaccctgatccagcgatgccgcgtgagtgatgaaggccttagggttgtaaaactctttcagatgggaagataatgacggtaccatcagaagaagctccggctaactccgtgccagcagccgcggtaatacggagggagctagcgttgttcggaattactgggcgtaaagcgcgcgtaggcggcttagcaagttgggggtgaaatcccggggctcaacctcggaactgcctccaaaactgctaagctagaatcctggagaggtgagcggaattcctagtgtagaggtgaaattcgtagatattaggaagaacaccagtggcgaaggcggctcactggacaggtattgacgctgaggtgcgaaagcgtggggagcgaacaggattagataccctggtagtccacgccgtaaacgatggatgctaggtgttgggtagcttgctattcagtgccgaagctaacgcgttaagcatcccgcctggggagtacggtcgcaagattaaaactcaaaggaattgacgggggcccgcacaagcggtggagcatgtggtttaattcgaagcaacgcgcagaaccttaccagcccttgacataccgatcgcgatttccggagacggatttcttcagttcggctggatcggatacaggtgctgcatggctgtcgtcagctcgtgtcgtgagatgttgggttaagtcccgcaacgagcgcaaccctcgcctttagttgccatcatttagttgggcactctagaggaactgccggtgataagccggaggaaggtggggatgacgtcaagtcctcatggcccttatgggctgggctacacacgtgctacaatggcggtgacagagagctgctacccagcgatggggtgctaatctctaaaagccgtctcagttcggattgttctctgcaactcgagagcatgaagttggaatcgctagtaatcgcagatcagcatgctgcggtgaatacgttcccgggccttgtacacaccgcccgtcacaccatgggagttggttttacctgacgccggtgggctaaccttttggaggcagccgaccacggtagagtcagcgactggggtgaagtcgtaacaaggtagccgtaggggaacctgcggctggatcacctcctttctaagga

SEQ ID NO: 4539 - DNA, 1554 bp, Kosakonia arachidis
  ref <308>: DATABASE ACCESSION NUMBER: NCBI ACCESSION: NZ_FPAU01000023.1
  ref <309>: DATABASE ENTRY DATE: 2019-04-01
  ref <313>: RELEVANT RESIDUES IN SEQ ID NO: (1)..(1554)
ttaaattgaagagtttgatcatggctcagattgaacgctggcggcaggcctaacacatgcaagtcgaacggtagcacagaggagcttgctcttcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtacggttaataaccgtgctgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttgccagagatggcttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4540 - DNA, 1553 bp, Kosakonia cowanii
  ref <308>: DATABASE ACCESSION NUMBER: NCBI ACCESSION: NZ_CP035129.1
  ref <309>: DATABASE ENTRY DATE: 2019-04-01
  ref <313>: RELEVANT RESIDUES IN SEQ ID NO: (1)..(1553)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggaaaggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4541 - DNA, 1552 bp, Kosakonia oryzendophytica
  ref <308>: DATABASE ACCESSION NUMBER: NCBI ACCESSION: NZ_FYBE01000045.1
  ref <309>: DATABASE ENTRY DATE: 2019-04-01
  ref <313>: RELEVANT RESIDUES IN SEQ ID NO: (1)..(1552)
ttaaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4542 - DNA, 1550 bp, Kosakonia sp. AG348
  ref <308>: DATABASE ACCESSION NUMBER: NCBI ACCESSION: NZ_QPJR01000019.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaggttaataaccttattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4543 - DNA, 1552 bp, Kosakonia sp. CCTCC M2018092
  ref <308>: DATABASE ACCESSION NUMBER: NCBI ACCESSION: NZ_CP034225.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataatgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4544 - DNA, 1550 bp, Kosakonia sp. H7A
  ref <308>: DATABASE ACCESSION NUMBER: NCBI ACCESSION: NZ_PYTZ01000022.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcggtacggttaataaccgtgccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacctggcagagatgccggggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4545 - DNA, 1498 bp, Kozakia baliensis
  ref <308>: DATABASE ACCESSION NUMBER: NCBI ACCESSION: NZ_CP014681.1
  ref <309>: DATABASE ENTRY DATE: 2019-04-01
  ref <313>: RELEVANT RESIDUES IN SEQ ID NO: (1)..(1498)
tgaacctgagagtttgatcctggctcagagcgaacgctggcggcatgcttaacacatgcaagtcgcacggacctttcggggttagtggcggacgggtgagtaacgcgtagggatctatccatgggtgggggataacactgggaaactggtgctaataccgcatgatgcctgagggccaaaggcgcaagtcgcctgtggaggagcctgcgttcgattagcttgttggtggggtaaaggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaataactgggcgtaaagggcgcgtaggcggtttggacagtcagatgtgaaattcctgggcttaacctgggggctgcatttgatacgtacagactagagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggcaacttagttgctcagtgtcgtagctaacgcgctaagcacaccgcctggggagtacggccgcaaggttgaaactcaaaggaattgacgggggcccgcacaagcggtggagcatgtggtttaattcgaagcaacgcgcagaaccttaccagggcttgacatggggaggctgtagccagagatggttatttcccgcaagggacctcctgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgtcctgggctacacacgtgctacaatggcggtgacagtgggaagctagacagcgatgtcatgccgatctctaaaaaccgtctcagttcggattgcactctgcaactcgagtgcatgaaggtggaatcgctagtaatcgcggatcagcatgccgcggtgaatacgttcccgggccttgtacacaccgcccgtcacaccatgggagttggttcgaccttaagccggtgagcgaacccagcaatggggcgcagccgatcacggtcgggttagcgactagggtgaagtcgtaacaaggtagccgtaggggaacctgcggctggatcacctcctttcaag

SEQ ID NO: 4546 - DNA, 1631 bp, Kroppenstedtia eburnea
  ref <308>: DATABASE ACCESSION NUMBER: NCBI ACCESSION: NZ_FTOD01000026.1
  ref <309>: DATABASE ENTRY DATE: 2019-04-01
  ref <313>: RELEVANT RESIDUES IN SEQ ID NO: (1)..(1631)
ctttattgaagagtttgatcctggctcaggacgaacgctggcggcgtgcctaatacatgcaagtcgagcgatctggaggttggagattagaggttagaagttagacgaaaccaatcggcgaagccgattggatgaatctgatttccaacttccaatctccaacttccagggagcggcggacgggtgagtaacacgtgggcaacctgcccgcaagaccgggataactccgggaaaccggggctaataccggatgatgcctcttcctgcatgggaggatgctgaaaggcggcctttggctgtcacttgcggatgggcccgcggcgcattagctggttggtgaggtaacggctcaccaaggcgacgatgcgtagccgacctgagagggtgaccggccacactgggactgagacacggcccagactcctacgggaggcagcagtagggaattttccgcaatgggcgcaagcctgacggagcaacgccgcgtgagtgaggacggctttcgggttgtaaaactctgttcttcgggaagaacggtcgaagggtgaacaatcctttggcgtgacggtaccggaggagaaagccccggctaactacgtgccagcagccgcggtaatacgtagggggcaagcgttgtccggaattattgggcgtaaagcgcgcgcaggcggcctgttaagtctggtgtgaaagaccacggctcaaccgtggggtggcatcagaaactggcgggcttgagtgcaggagaggagagtggaattcccggtgtagcggtggaatgcgtagagatcgggaggaacaccagtggcgaaggcgactctctggcctgtaactgacgctgaggcgcgaaagcgtggggagcgaacaggattagataccctggtagtccacgccgtaaacgatgagtgctaggtgttgggggttccgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccggtgcagagatgcaccttcccttcggggcagcggtgacaggtggtgcatggttgtcgtcagctcgtgtcgtgagatgttgggttcagtcccgcaacgagcgcaacccttgtcgtcagttgccagcacatgatggtgggcactctggcgagacagccggtgaaagccggaggaaggtggggatgacgtcaaatcatcatgccccttatgtcctgggctacacacgtgctacaatggccggtacaacgggcagcgaacccgtgagggggagccaatcccaaaaaaccggtctcagttcggatcgcaggctgcaactcgcctgcgtgaagctggaatcgctagtaatcgcggatcagcatgccgcggtgaatccgttcccgggccttgtacacaccgcccgtcacaccacgagagtctgcaacacccgaagtcggtgaggtaaccttcgggaaccagccgccgaaggtggggcagatgattggggtgaagtcgtaacaaggtatccctaccggaaggtggggatggatcacctcctttctacggag

SEQ ID NO: 4547 - DNA, 1526 bp, Kroppenstedtia sanguinis
  ref <308>: DATABASE ACCESSION NUMBER: NCBI ACCESSION: NZ_QWDJ02000014.1
  ref <309>: DATABASE ENTRY DATE: 2019-04-01
  ref <313>: RELEVANT RESIDUES IN SEQ ID NO: (1)..(1526)
tttcatggagagtttgatcctggctcaggacgaacgctggcggcgtgcttaacacatgcaagtcgaacggaaaggccccacttgtggggtactcgagtggcgaacgggtgagtaacacgtgggtgatctgccccaaactttgggataagcctgggaaactgggtctaataccggatatgaccttctcctgcatgggggttggtggaaagcttttgcggtttgggatgggcccgcggcctatcagcttgttggtggggtaatggcctaccaaggcgacgacgggtagccgacctgagagggtgatcggccacactgggactgagacacggcccagactcctacgggaggcagcagtggggaatattgcacaatgggcgcaagcctgatgcagcgacgccgcgtgagggatgacggccttcgggttgtaaacctctttcgccagggacgaagcgtaagtgacggtacctggagaagaagcaccggccaactacgtgccagcagccgcggtaatacgtagggtgcgagcgttgtccggaattactgggcgtaaagagctcgtaggcggtttgtcgcgtcgtctgtgaaattctgcaactcaattgtaggcgtgcaggcgatacgggcagacttgagtactacaggggagactggaattcctggtgtagcggtgaaatgcgcagatatcaggaggaacaccggtggcgaaggcgggtctctgggtagttactgacgctgaggagcgaaagcgtggggagcgaacaggattagataccctggtagtccacgccgtaaacggtgggtactaggtgtgggttccatttcacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagacgacggtagagatatcgtttcccttgtggttggtgtacaggtggtgcatggctgtcgtcagctcgtgtcgtgagatgttgggttaagtcccgcaacgagcgcaacccttgtcctgtattgccagcgggttatgccggggacttgcaggagactgccggggtcaactcggaggaaggtggggatgacgtcaagtcatcatgccccttatgtccagggcttcacacatgctacaatggcgcgtacagagggctgcgataccgtgaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagctgtcgaaggtgggatcggcgattgggacgaagtcgtaacaaggtagccgtaccggaaggtgcggctggatcacctcctttctaa

SEQ ID NO: 4548 - DNA, 1490 bp, Ktedonobacter racemifer
  ref <308>: DATABASE ACCESSION NUMBER: NCBI ACCESSION: NZ_ADVG01000004.1
  ref <309>: DATABASE ENTRY DATE: 2019-04-01
  ref <313>: RELEVANT RESIDUES IN SEQ ID NO: (1)..(1490)
caacttgaatggcgagtttgatcctggctcaggataaacgctggcggcgtgcctaacacatgcaagtcgaacgccctctcgcaagagagggagtggcggacgggtgagtaacacatgggtacctgccccgaggtgaggaataccggcgagaaatcgccgacaataccgcatacgttcctccgggaacaaagctcgcaagggcgccttgggatgggcctgtggccgattagcttgttggtgaggtaagagctcaccaaggccacgatcggtagctggtctgagaggatggtcagccacactgggattgagaacggcccagactcctacggggggcagcagtgaggaattttcgtcaatgggggcaaccctgaacgagcaacgccgcgtgcaggaggacgcttttcggagtgtaaactgcttttcttggggacgagtaaggacggtacccaaggaataagccccggctaactacgtgccagcagccgcggtaatacgtagggggcaagcgttgtccggagttattgggcgtaaagcgcacgcaggcggtttcgtacgtccggagtgacagttcccggctcaactgggaaaggtcttcggaaacggcgagacttgagggcttcagagggacacggaattccgggtggagtggtgaaatgcgtagagatccggaggaacaccaatggcgaaggcagtgtcctgggaagcatctgacgctcaggtgcgaaagctaggggagcgaacaggattagataccctggtagtcctagccgtaaacgatgaccactaggtgtgggaggtatcgaccccttccgtgccgtcgcaaacgcagtaagtggtccgcctggggagtacggtcgcaagattaaaactcaaaggaattgacggggacccgcacaagcagcggagcgtgtggtttaattcgatgcaacgcgaagaaccttaccaagtcttgacatgcagatgcaccagcggtaatgcgctgtcccttcggggcgtttgcacaggtgctgcatggctgtcgtcagctcgtgtcgtgagatgttgggttaagtcccgcaacgagcgcaacccctactgcctattacaacttctaggcggaactgccctcacgggaggaaggcggggatgacgtcaagtcagcacggcccttacgacttgggcgacacacacgctacaatggccagaaacaaagggatgccaacccgcgagggggagccaagctcaaaaacctggtctcagttcagattgcaggctgaaactcgcctgcatgaaggtggagttgctagtaaccgtaggtcagcacactacggtgaatacgttcccgggtcttgtacacaccgcccgtcacaccacgaaagtcggcaacacctgaagccgccaggctaactcttcggagaggcaggcgtcgagggtggggttggtgattggggtgaagtcgtaacaaggtagctgtaccggaaggtgcggctggatcacctcctttctaggga

SEQ ID NO: 4549 - DNA, 1494 bp, Ktedonobacterales bacterium SCAWS-G2
  ref <308>: DATABASE ACCESSION NUMBER: NCBI ACCESSION: NZ_CP035758.1
  ref <309>: DATABASE ENTRY DATE: 2019-04-01
  ref <313>: RELEVANT RESIDUES IN SEQ ID NO: (1)..(1494)
atggcgagtttgatcctggctcaggataaacgctggcggcgtgcctaacacatgcaagtcgaacgccttctggcaacagagggagtggcggacgggtgaggaacacgtgggttatctacctccgggtgaggaataccaccgggaaaccggtgacaataccgcatacgtttcccttcgcggggaaacaaagcttcgcaagaggcgccgggagatgagcctgcggccgattagctggttggtggggtaaaagcctaccaaggcgacgatcggtagctggtctgagaggacgatcagccacactgggattgagaacggcccagactcctacggggggcagcagtgaggaattttccgcaatggtcgcaagactgacggagcaacgccgcgtgcaggaagacggccttcgggttgtaaactgcttttctgagggacgagcaaggacggtacctcaggaatcagctccggctaactacgtgccagcagccgcggtaatacgtagggagcaagcgttgtccggagttactgggcgtaaagcgcacgcaggcggtgaaccaagtttggagtgacagtcctcggcttaactgaggaagtgcttcgaaaactggctcacttgagggcttcagagggacagggaattccgggtgtagtggtgaaatgcgtagatatccggaggaacaccaaaggcgtaggcactgtcctggggagtcactgacgctcaggtgcgaaagctaggggagcgaacgggattagataccccggtagtcctagccgtaaacgatgaccaccaggtgtgggaggtatcgaccccttccgtgccggcgctaacgctttaagtggtccgcctggggagtacggtcgcaagattaaaactcaaaggaattgacggggacccgcacaagcagcggagcgtgtggtttaattcgatgcaacgcgaagaaccttaccagggcttgacatggagttgcaccacccagagatgggtgtcccttcggggcggctccacaggtgctgcatggctgtcgtcagctcgtgtcgtgagatgttgggttaagtcccgcaacgagcgcaacccctatcgtcggttacaagtgtccggcgagactgccgcgatcaacgtggaggaaggcggggatgacgtcaagtcagcacggcccttacgtcctgggcgacacacacgctacaatggccacgacaaagggtcgccaacccgcgagggggagctaatcccaacaaacgtggtctcagttcagattgtaggctgcaacccgcctgcatgaagttggagttgctagtaaccgtgggtcagcacaccacggtgaatacgttcccgggtcttgtacacaccgcccgtcacaccacgaaagtcggcaacacctgaagccgctgggctaacccgcaaggggggcaagcgtcgagggtggggtcggtgattggggtgaagtcgtaacaaggtagccgtaccggaaggtgcggctggatcacctcctttctagg

SEQ ID NO: 4550 - DNA, 1507 bp, Ktedonobacterales bacterium Uno11
  ref <308>: DATABASE ACCESSION NUMBER: NCBI ACCESSION: NZ_BIFS01000002.1
  ref <309>: DATABASE ENTRY DATE: 2019-04-01
  ref <313>: RELEVANT RESIDUES IN SEQ ID NO: (1)..(1507)
atggcgagtttgatcctggctcaggataaacgctggcggcgtgcctaacacatgcaagtcgaacgcccttagcaataagggagtggcggacgggtgaggaacacgtgggttatctacccccaggtgaggaataccggcgagaaatcgccgacaataccgcataggctcggcaacgagcaaagcccgcaagggcgcctgaggacgagcctgcgctcgattagttggttggtggggtaatggcctaccaagactgcgatcgatagctggtctgagaggacgatcagccacactgggattgagaacggcccagactcctacggggggcagcagtgaggaattttcgtcaatgggggcaaccctgaacgagcaacgccgcgtgcaggaagaaggttttcggatcgtaaactgcttttctctgggacgagaacggacggtaccagaggaatcagccccggctaactacgtgccagcagccgcggtaatacgtagggggcaagcgttgtccggatttattgggcgtaaagcgcacgcaggcggtcaggtaagtttgtggtgacagtcgtcggctcaaccgacgaagtactgcggaaactgtctgacttgagggcttcagagggacacggaattccgggtggagtggtgaaatgcgtagatatccggaggaacaccgatggcgaaggcagtgtcctgggaagtacctgacgctcaggtgcgaaagctaggggagcgaacaggattagataccctggtagtcctagccgtaaacgatgaccactagacgttggggtatcgaccccttcagtgtcgtagttacacagtatgtccgctggagtaccgattacgtgtacacagctagacataagtcggacgcaagattaaaactcaaaggaattgacggggacccgcacaagcagcggagcgtgtggtttaattcgatgcaacgcgaagaaccttaccaaggcttgacatggatttgcaccagccgtaacgggctgtcccttcggggcggatccacaggtgctgcatggctgtcgtcagctcgtgtcgtgagatgttgggttaagtcccgcaacgagcgcaacccctgtcgttagttgaatttttctagcgaaactgccgttttaaaacggaggaaggcggggatgacgtcaagtcagcacggcccttacgctttgggcgacacacacgctacaatggtcaggacaaagagttgcgaacccgcgagggggagccaatctcgtcaaacctggcctcagttcagattggaggctgcaacccgcctccatgaagttggagttgctagtaaccgtaggtcagcacactacggtgaatacgttcccgggtcttgtacacaccgcccgtcacaccacgaaagttggcaacacttgaagccgctgggctaactcgcaagaggggcaagcgtcgagggtggggtcagtgattggggtgaagtcgtaacaaggtagccgtaccggaaggtgcggctggatcacctcctttctaggga

SEQ ID NO: 4551 - DNA, 1491 bp, Ktedonobacterales bacterium Uno16
  ref <308>: DATABASE ACCESSION NUMBER: NCBI ACCESSION: NZ_BIFT01000001.1
  ref <309>: DATABASE ENTRY DATE: 2019-04-01
  ref <313>: RELEVANT RESIDUES IN SEQ ID NO: (1)..(1491)
atggcgagtttgatcctggctcaggataaacgctggcggcgtgcctaacacatgcaagtcgaacgctctgcgcaagcagggagtggcggacgggtgagtaacacgtgggcaatctaccatcaggtgaggaataccggcgagaaatcgccgacaataccgcatacgctctttcgcgaggaagagcaaagctcgtaagggcgcctgaggatgagcctgcgctcgattagtttgttggtgaggtaatggcttaccaagacgacgatcgatagctggtctgagaggacgatcagccacactgggattgagaacggcccagactcctacggggggcagcagtgaggaattttcgtcaatgggggcaaccctgaacgagcaacgccgcgtgcaggatgaaggttttcggatcgtaaactgcttttctctgggacgagaacggacggtaccagaggaatcagccccggctaactacgtgccagcagccgcggtaatacgtagggggcaagcgttgtccggatttattgggcgtaaagcgcacgcaggcggtcagatcagtctggggtgacagtcgtcggctcaaccgacgaagtacttcggatactgtctgacttgagggcttcagagggacacggaattccgggtggagtggtgaaatgcgtagatatccggaggaacaccgatggcgaaggcagtgtcctgggaagtacctgacgctcaggtgcgaaagctaggggagcgaacaggattagataccctggtagtcctagccgtaaacgatgaccactagacgttgggggtatcgaccccttcagtgtcgcagttaacacagtaagtggtccgcctggggagtacggtcgcaagattaaaactcaaaggaattgacggggacccgcacaagcagcggagcgtgtggtttaattcgatgcaacgcgaagaaccttaccaaggcttgacatggatttgcaccagccgtaattggttgtcccttcggggcggatccacaggtgctgcatggctgtcgtcagctcgtgtcgtgagatgttgggttaagtcccgcaacgagcgcaacccctgtcgttagttgaatttctctagcgaaactgccattttaaaatggaggaaggcggggatgacgtcaagtcagcacggcccttacgctttgggcgacacacacgctacaatggtcaggacaaagagttgcgaactcgcgagagggagccaatctcgtcaaacctggcctcagttcagattggaggctgcaacccgcctccatgaagttggagttgctagtaaccgtaggtcagcacactacggtgaatacgttcccgggtcttgtacacaccgcccgtcacaccacgaaagttggcaacacttgaagccgctgggctaactcgcaagaggggcaagcgtcgagggtggggtcagtgattggggtgaagtcgtaacaaggtagccgtaccggaaggtgcggctggatcacctcctttctaggga

SEQ ID NO: 4552 - DNA, 1483 bp, Ktedonobacterales bacterium Uno3
  ref <308>: DATABASE ACCESSION NUMBER: NCBI ACCESSION: NZ_BIFR01000002.1
  ref <309>: DATABASE ENTRY DATE: 2019-04-01
  ref <313>: RELEVANT RESIDUES IN SEQ ID NO: (1)..(1483)
ggatggcgagtttgatcctggctcaggataaacgctggcggcgtgcctaacacatgcaagtcgaacgcactcagcaatgagtgagtggcggacgggtgagtaacgcgtggattatctgccccaaagtgaggaataccggcgagaaatcgccgacaataccgcatatgctcgcaagaggaaagctcgcaagggcgctttgggatgggtctgcgtctgattagctagttggtgaggtcaaggcttaccaaggcgacgatcagtagctggtctgagaggacgatcagccacactgggattgagaacggcccagactcctacggggggcagcagtgaggaattttcgtcaatgggggcaaccctgaacgagcaacgccgcgtgcaggatgacggttttcggatcgtaaactgcttttcttggggacgagaacggacggtacccaaggaagaagccccggctaactacgtgccagcagccgcggtaatacgtagggggcaagcgttgtccggatttattgggcgtaaagcgcacgcaggcggtcaggtaagtttgtactgacaatctccggctcaactggagagggtgtatgaagactgcccgacttgagggcttcagagggacacggaattccgggtggagtggtgaaatgcgtagatatccggaggaacaccaatggcgaaggcagtgtcctgggaagtacctgacgctcaggtgcgaaagccaggggagcgaacgggattagataccccggtagtcctggccgtaaacgatgaccactaggcgttgggaggttcgaccctctcagtgccggagctaacgtttgaagtggtccgcctggggagtacggtcgcaagattaaaactcaaaggaattgacggggacccgcacaagcagcggagcgtgtggtttaattcgatgcaacgcgaagaaccttaccaggacttgacatggaattgcaccagcggtaacgcgctgtcccttcggggcggttccacaggtgctgcatggctgtcgtcagctcgtgtcgtgagatgttgggttaagtcccgcaacgagcgcaacccctgtcgttagttgaatgatctaacgaaactgccgcgatcaacgtggaggaaggcggggatgacgtcaagtcagcacggcccttacgtcctgggcgacacacacgctacaatggtcgagacaaagagttgcgaacccgcgagggggagccaatctcgtcaaactcggcctcagttcagattggaggctgcaacccgcctccatgaagtgggagttgctagtaaccgtaggtcagcacactacggtgaatacgttcccgggtcttgtacacaccgcccgtcacaccacgaaagtcggcaacacctgaagccgctgggctaacccttcggggaggcaagcgtcgagggtggggtcggtgattggggtgaagtcgtaacaaggtagccgtaccggaaggtgcggctggatcacctcctttctagg

SEQ ID NO: 4553 - DNA, 867 bp, Kurthia gibsonii
  ref <308>: DATABASE ACCESSION NUMBER: NCBI ACCESSION: NZ_QZNE01000010.1
  ref <309>: DATABASE ENTRY DATE: 2019-04-01
  ref <313>: RELEVANT RESIDUES IN SEQ ID NO: (1)..(867)
tttatggagagtttgatcctggctcaggacgaacgctggcggcgtgcctaatacatgcaagtcgagcgaatgacgagaagcttgcttctctgatttagcggcggacgggtgagtaacacgtgggcaacctgccctacagatcgggataactcagggaaacctgggctaataccggataatccttcgaatcacatgttttgaagttgaaaggcgcttcggcgtcactgtaggatgggcccgcggtgcattagctagttggtggggtaacggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttaggaaatgaacgtaccttgacggtaccttattagaaagccacggctaactacgtgccagcagccgcggtaatacgtaggtggcaagcgttgtccggatttattgggcgtaaagcgcgcgcaggtggtttcttaagtctgatgtgaaagcccacggctcaaccgtggagggtcattggaaactggggaacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagc

SEQ ID NO: 4554 - DNA, 1564 bp, Kurthia huakuii
  ref <308>: DATABASE ACCESSION NUMBER: NCBI ACCESSION: NZ_AYTB01000001.1
  ref <309>: DATABASE ENTRY DATE: 2019-04-01
  ref <313>: RELEVANT RESIDUES IN SEQ ID NO: (1)..(1564)
ttttatggagagtttgatcctggctcaggacgaacgctggcggcgtgcctaatacatgcaagtcgagcgaggttgtttggaatgcttgcatttcaaacaacctagcggcggacgggtgagtaacacgtgggcaacctgccctgtagactgggataacttcgggaaaccggagctaataccggataactcttttagcctcatggctttaagctaaaaggcgcttcggcgtcactacaggatgggcccgcggtgcattagctagttggtagggtaacggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtgcgttaggtaatgaacgcgccttgacggtaccttattagaaagccacggctaactacgtgccagcagccgcggtaatacgtaggtggcaagcgttgtccggatttattgggcgtaaagcgcgcgcaggtggtttcttaagtctgatgtgaaagcccacggctcaaccgtggagggtcattggaaactggggaacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccaatgaccgtcttagagataagactttcccttcggggacattggtgacaggtggtgcatggttgtcgtcagctcgtgtcgtgagatgttgggttaagtcccgcaacgagcgcaacccttattcttagttgccatcatttagttgggcactctaaggagactgccggtgacaaaccggaggaaggtggggatgacgtcaaatcatcatgccccttatgacctgggctacacacgtgctacaatggacggtacagagagctgcaagcccgcgagggttagccaatctcataaaaccgttctcagttcggattgtagtctgcaactcgactacatgaagccggaatcgctagtaatcgcggatcagcatgccgcggtgaatacgttcccgggccttgtacacaccgcccgtcacaccacgagagtttgtaacacccgaagccggtggggtaaccatttatggagccagccgtctaaggtgggatagatgattggggtgaagtcgtaacaaggtagccgtatcggaaggtgcggctggatcacctcctttctaagga

SEQ ID NO: 4555 - DNA, 1559 bp, Kurthia massiliensis
  ref <308>: DATABASE ACCESSION NUMBER: NCBI ACCESSION: NZ_CAEU01000072.1
  ref <309>: DATABASE ENTRY DATE: 2019-04-01
  ref <313>: RELEVANT RESIDUES IN SEQ ID NO: (1)..(1559)
ttttatggagagtttgatcctggctcaggacgaacgctggcggcgtgcctaatacatgcaagtcgagcgaatgacgagaagcttgcttctctgatttagcggcggacgggtgagtaacacgtgggtaacctgccctgtagactgggataacttcgggaaaccggagctaataccggataattcttttagtctcatgactttaagctaaaaggcgcttcggcgtcactacaggatggacccgcggtgcattagctagttggtgaggtaacggctcaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttaggtaatgaacgtaccttgacggtaccttatcagaaagccacggctaactacgtgccagcagccgcggtaatacgtaggtggcaagcgttgtccggatttattgggcgtaaagcgcgcgcaggtggtttcttaagtctgatgtgaaagcccccggctcaaccggggagggtcattggaaactgggagacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccaatgaccgttctagagatagaacttttcccttcggggacattggtgacaggtggtgcatggttgtcgtcagctcgtgtcgtgagatgttgggttaagtcccgcaacgagcgcaacccttattcttagttgccatcatttagttgggcactctaaggagactgccggtgacaaaccggaggaaggtggggatgacgtcaaatcatcatgccccttatgacctgggctacacacgtgctacaatggacggtacaaagagctgcgagcccgcgagggtaagccaatctcataaaaccgttctcagttcggattgtagtctgcaactcgactacatgaagccggaatcgctagtaatcgcggatcagcatgccgcggtgaatacgttcccgggccttgtacacaccgcccgtcacaccacgagagtttgtaacacccgaagtcggtggggtaacctttatggggccagccgcctaaggtgggatagatgattggggtgaagtcgtaacaaggtagccgtatcggaaggtgcggctggatcacctcctttctaaggaa

SEQ ID NO: 4556 - DNA, 1560 bp, Kurthia sibirica
  ref <308>: DATABASE ACCESSION NUMBER: NCBI ACCESSION: NZ_QFVR01000055.1
  ref <309>: DATABASE ENTRY DATE: 2019-04-01
  ref <313>: RELEVANT RESIDUES IN SEQ ID NO: (1)..(1560)
tttatggagagtttgatcctggctcaggacgaacgctggcggcgtgcctaatacatgcaagtcgagcgaatgatgaagaagcttgcttcttctgatttagcggcggacgggtgagtaacacgtgggcaacctgccctacagattgggataactccgggaaaccggggctaataccgaataatccattttgcctcatggcgaaatgttgaaaggcgcttcggcgtcactgtaggatgggcccgcgctgcattagctagttggtgaggtaacggctcaccaaggccacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtgcgttaggtaatgaacgcaccatgacggtaccttattagaaagccacggctaactacgtgccagcagccgcggtaatacgtaggtggcaagcgttgtccggatttattgggcgtaaagcgcgcgcaggtggtttcttaagtctgatgtgaaagcccccggctcaaccggggagggtcattggaaactgggaaacttgagtacagaagaggatagtggaattccaagtgtagcggtgaaatgcgtagagatttggaggaacaccagtggcgaaggcgactgtctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccaatgaccgtcctagagataggattttcccttcggggacattggtgacaggtggtgcatggttgtcgtcagctcgtgtcgtgagatgttgggttaagtcccgcaacgagcgcaacccttaatgttagttgccatcatttagttgggcactctaatgtgactgccggtgataaaccggaggaaggtggggatgacgtcaaatcatcatgccccttatgacctgggctacacacgtgctacaatgggcgatacaaagagtcgcaaactcgcgagggtaagctaatctcataaaatcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccatttatggagccagccgcctaaggtgggatagatgattggggtgaagtcgtaacaaggtagccgtatcggaaggtgcggctggatcacctcctttctaaggaa

SEQ ID NO: 4557 - DNA, 1557 bp, Kurthia sp. 11kri321
  ref <308>: DATABASE ACCESSION NUMBER: NCBI ACCESSION: NZ_CP013217.1
  ref <309>: DATABASE ENTRY DATE: 2019-04-01
  ref <313>: RELEVANT RESIDUES IN SEQ ID NO: (1)..(1557)
ttttatggagagtttgatcctggctcaggacgaacgctggcggcgtgcctaatacatgcaagtcgagcgaatgacgagaagcttgcttctctgatttagcggcggacgggtgagtaacacgtgggcaacctgccctacagatcgggataactcagggaaacctgggctaataccggataatccttcgaatcacatgttttgaagttgaaaggcgcttcggcgtcactgtaggatgggcccgcggtgcattagctagttggtggggtaacggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttaggaaatgaacgtaccttgacggtaccttattagaaagccacggctaactacgtgccagcagccgcggtaatacgtaggtggcaagcgttgtccggatttattgggcgtaaagcgcgcgcaggtggtttcttaagtctgatgtgaaagcccacggctcaaccgtggagggtcattggaaactgggggacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccaatgaccgtcctagagataggattttcccttcggggacattggtgacaggtggtgcatggttgtcgtcagctcgtgtcgtgagatgttgggttaagtcccgcaacgagcgcaacccttattcttagttgccatcatttagttgggcactctaaggagactgccggtgacaaaccggaggaaggtggggatgacgtcaaatcatcatgccccttatgacctgggctacacacgtgctacaatggacgatacaaagagtcgcaaactcgcgagggtaagctaatctcataaaatcgttctcagttcggattgtaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggatagatgattggggtgaagtcgtaacaaggtagccgtatcggaaggtgcggctggatcacctcctttctaaggaa

SEQ ID NO: 4558 - DNA, 1036 bp, Kurthia sp. 3B1D
  ref <308>: DATABASE ACCESSION NUMBER: NCBI ACCESSION: NZ_JTFC01000069.1
  ref <309>: DATABASE ENTRY DATE: 2019-04-01
  ref <313>: RELEVANT RESIDUES IN SEQ ID NO: (1)..(1036)
ccagcagccgcggtaatacgtaggtggcaagcgttgtccggatttattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccaatgaccgtcttagagataagattttcccttcggggacattggtgacaggtggtgcatggttgtcgtcagctcgtgtcgtgagatgttgggttaagtcccgcaacgagcgcaacccttattcttagttgccatcatttagttgggcactctaaggagactgccggtgacaaaccggaggaaggtggggatgacgtcaaatcatcatgccccttatgacctgggctacacacgtgctacaatggacggtacaaagagctgcaagcccgcgagggttagccaatctcataaaaccgttctcagttcggattgtagtctgcaactcgactacatgaagccggaatcgctagtaatcgcggatcagcatgccgcggtgaatacgttcccgggccttgtacacaccgcccgtcacaccacgagagtttgtaacacccgaagccggtggggtaaccatttatggagccagccgtctaaggtgggatagatgattggggtgaagtcgtaacaaggtagccgtatcggaaggtgcggctggatcacctcctttctaagga

SEQ ID NO: 4559 - DNA, 1562 bp, Kurthia zopfii
  ref <308>: DATABASE ACCESSION NUMBER: NCBI ACCESSION: NZ_LR134474.1
  ref <309>: DATABASE ENTRY DATE: 2019-04-01
  ref <313>: RELEVANT RESIDUES IN SEQ ID NO: (1)..(1562)
tttatggagagtttgatcctggctcaggacgaacgctggcggcgtgcctaatacatgcaagtcgagcgagattatttgagtgcttgcactcaaataatctagcggcggacgggtgagtaacacgtgggcaacctgccctacagtttgggataactccgggaaaccggggctaataccgaataatccttcgaatcacatggtttgaagttgaaaggcgcttcggcgtcgctgtaggatgggcccgcggtgcattagctagttggtggggtaatggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtgcgttaggtaatgaacgcaccttgacggtaccttattagaaagccacggctaactacgtgccagcagccgcggtaatacgtaggtggcaagcgttgtccggatttattgggcgtaaagcgcgcgcaggtggtttcttaagtctgatgtgaaagcccacggctcaaccgtggagggtcattggaaactggggaacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccaatgaccgctctagagatagagttttcccttcggggacattggtgacaggtggtgcatggttgtcgtcagctcgtgtcgtgagatgttgggttaagtcccgcaacgagcgcaacccttattcttagttgccatcatttagttgggcactctaaggagactgccggtgacaaaccggaggaaggtggggatgacgtcaaatcatcatgccccttatgacctgggctacacacgtgctacaatggacgatacaaagagtcgcaaactcgcgagggcaagctaatctcataaaatcgttctcagttcggattgtaggctgcaactcgcctgcatgaagccggaatcgctagtaatcgtagatcagcatgctacggtgaatacgttcccgggccttgtacacaccgcccgtcacaccacgagagtttgtaacacccgaagtcggtggggtaaccatttatggagccagccgcctaaggtgggatagatgattggggtgaagtcgtaacaaggtagccgtatcggaaggtgcggctggatcacctcctttctaaggaa

SEQ ID NO: 4560 - DNA, 1544 bp, Kushneria indalinina
  ref <308>: DATABASE ACCESSION NUMBER: NCBI ACCESSION: NZ_QRDJ01000014.1
  ref <309>: DATABASE ENTRY DATE: 2019-04-01
  ref <313>: RELEVANT RESIDUES IN SEQ ID NO: (1)..(1544)
taaactgaagagtttgatcatggctcagattgaacgctggcggcaggcctaacacatgcaagtcgagcggtaacaggggtagcttgctacccgctgacgagcggcggacgggtgagtaatgcatgggtatctgcccggtagtgggggataactcggggaaacccgagctaataccgcatacgtcctacgggagaaagcaggggatcttcggaccttgcgctatcggatgagcccatgtcggattagcttgttggtgaggtaatggctcaccaaggccgcgatccgtagctggtctgagaggatgatcagccacaccgggactgagacacggcccggactcctacgggaggcagcagtggggaatattggacaatgggggaaaccctgatccagccatgccgcgtgtgtgaagaaggccttcgggttgtaaagcactttcagtggggaagaaggcatggtggttaataaccaccatgaaggacatcacccacagaagaagcaccggctaactccgtgccagcagccgcggtaatacggagggtgcaagcgttaatcggaattactgggcgtaaagggcgcgtaggcggcttgccaagccggatgtgaaagccccgggctcaacccgggaacggcattcggaactggcaggctagagtgcaggagaggaaggtggaattcccggtgtagcggtgaaatgcgtagagatcgggaggaataccagtggcgaaggcggccttctggactgacactgacgctgaggcgcgaaagcgtgggtagcaaacaggattagataccctggtagtccacgccgtaaacgatgtcgaccagccgttggaccccttgagggtttggtggcgcagttaacgcaataagtcgaccgcctggggagtacggccgcaaggctaaaactcaaatgaattgacgggggcccgcacaagcggtggagcatgtggtttaattcgatgcaacgcgaagaaccttacctgctcttgacatcctgcgaatctcccagagatgggagagtgccttcgggagcgcagagacaggtgctgcatggctgtcgtcagctcgtgttgtgaaatgttgggttaagtcccgtaacgagcgcaacccctatccctttttgccagcggtccggccgggaacttcagggagactgccggtgacaaaccggaggaaggtggggacgacgtcaagtcatcatggcccttacgagcagggctacacacgtgctacaatggccggtacaaagggttgcgaagcggcgacgtgaagccaatcccataaagccggcctcagtccggatcggagtctgcaactcgactccgtgaagtcggaatcgctagtaatcgtggatcagaatgccacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 4561 - DNA, 1544 bp, Kushneria marisflavi
  ref <308>: DATABASE ACCESSION NUMBER: NCBI ACCESSION: NZ_RAPM01000009.1
  ref <309>: DATABASE ENTRY DATE: 2019-04-01
  ref <313>: RELEVANT RESIDUES IN SEQ ID NO: (1)..(1544)
taaactgaagagtttgatcatggctcagattgaacgctggcggcaggcctaacacatgcaagtcgagcggtaacaggggtagcttgctacccgctgacgagcggcggacgggtgagtaatgcatgggaatctgcccgatagtgggggataactcggggaaacccgagctaataccgcatacgtcctacgggagaaagcaggggatcttcggaccttgcgctatcggatgagcccatgtcggattagcttgttggtgaggtaaaggctcaccaaggctgcgatccgtagctggtctgagaggatgatcagccacaccgggactgagacacggcccggactcctacgggaggcagcagtggggaatattggacaatgggggaaaccctgatccagccatgccgcgtgtgtgaagaaggccttagggttgtaaagcactttcagtggggaagaaggcatgatgattaatactcgtcatgaaggacatcacccacagaagaagcaccggctaactccgtgccagcagccgcggtaatacggagggtgcaagcgttaatcggaattactgggcgtaaagggcgcgtaggcggcttgccaagccggatgtgaaagccccgggctcaacccgggaacggcattcggaactggcaggctagagtgcaggagaggaaggtggaattcccggtgtagcggtgaaatgcgtagagatcgggaggaataccagtggcgaaggcggccttctggactgacactgacgctgaggcgcgaaagcgtgggtagcaaacaggattagataccctggtagtccacgccgtaaacgatgtcgaccagccgttggaccccttgagggtttggtggcgcagttaacgcaataagtcgaccgcctggggagtacggccgcaaggctaaaactcaaatgaattgacgggggcccgcacaagcggtggagcatgtggtttaattcgatgcaacgcgaagaaccttacctgctcttgacatcctgcgaatctcccagagatgggagagtgccttcgggaacgcagagacaggtgctgcatggctgtcgtcagctcgtgttgtgaaatgttgggttaagtcccgtaacgagcgcaacccctatccctttttgccagcggtccggccgggaacttcagggagactgccggtgacaaaccggaggaaggtggggacgacgtcaagtcatcatggcccttacgagcagggctacacacgtgctacaatggccggtacaaagggttgcgaagcggcgacgtgaagccaatcccataaagccggcctcagtccggatcggagtctgcaactcgactccgtgaagtcggaatcgctagtaatcgtggatcagaatgccacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 4562 - DNA, 1539 bp, Kushneria sinocarnis
  ref <308>: DATABASE ACCESSION NUMBER: NCBI ACCESSION: NZ_RBIN01000015.1
  ref <309>: DATABASE ENTRY DATE: 2019-04-01
  ref <313>: RELEVANT RESIDUES IN SEQ ID NO: (1)..(1539)
caactgaagagtttgatcatggctcagattgaacgctggcggcaggcttaacacatgcaagtcgagcggcagcggacccttcggggtgccggcgagcggcggacgggtgagtaatgcatgggaatctgcccggtagtgggggataacccggggaaacccgggctaataccgcatacctcccacgggagaaagcaggggatcttcggaccttgcgctatcggatgagcccatgtcggattagcttgctggtgaggtaacggctcaccagggctgcgatccgtagctggtttgagagaatgatcagccacaccgggactgagacacggcccggactcctacgggaggcagcagtggggaatattggacaatgggcgaaagcctgatccagccatgccgcgtgtgtgaagaaggccctcgggttgtaaagcactttcagcggggaagaaggcgtggcggttaatacccgccacgaaggacatcacccgcagaagaagcaccggctaactccgtgccagcagccgcggtaatacggagggtgcaagcgttaatcggaattactgggcgtaaagggcgcgtaggcggcctgtcacgccgggtgtgaaagccccgggctcaacccgggaacggcatccggaacgggcaggctcgagtgcaggagaggaaggtagaattcccggtgtagcggtgaaatgcgtagagatcgggaggaataccagtggcgaaggcggccttctggactgacactgacgctgaggcgcgaaagcatgggtagcaaacaggattagataccctggtagtccatgccgtaaacgatgtcgaccagccgttggcctcctcgagaggctggtggcgcagttaacgcgctaagtcgaccgcctggggagtacggccgcaaggctaaaactcaaatgaattgacgggggcccgcacaagcggtggagcatgtggtttaattcgatgcaacgcgaagaaccttacctgcccttgacatcccgggaatccgccggagacggcggagtgccttcgggaacccggagacaggtgctgcatggctgtcgtcagctcgtgttgtgaaatgttgggttaagtcccgtaacgagcgcaacccctatccccatttgccagcggtccggccgggaactctggggagactgccggtgacaaaccggaggaaggtggggacgacgtcaagtcatcatggcccttacgggcagggctacacacgtgctacaatggcgagtacaaagggttgcgaagcggcgacgtgaagccaatcccgtaaagctcgcctcagtccggattggagtctgcaactcgactccatgaagtcggaatcgctagtaatcgcgtatcagaatggcgcggtgaatacgttcccgggccttgtacacaccgcccgtcacaccatgggagtggactgcaccagaagcggttagcccaaccttcgggagggcgaccgccacggtgtggttcacgactggggtgaagtcgtaacaaggtagccgtaggggaacctgcggctggatcacctccttaaac

SEQ ID NO: 4563 - DNA, 1526 bp, Kutzneria buriramensis
  ref <308>: DATABASE ACCESSION NUMBER: NCBI ACCESSION: NZ_QUNO01000051.1
  ref <309>: DATABASE ENTRY DATE: 2019-04-01
  ref <313>: RELEVANT RESIDUES IN SEQ ID NO: (1)..(1526)
cttattggagagtttgatcctggctcaggacgaacgctggcggcgtgcttaacacatgcaagtcgagcggtaaggcccttcggggtacacgagcggcgaacgggtgagtaacacgtgggcaacctgccctgcactctgggataagcccgggaaactgggtctaataccggatatgacctcgggtcgcatgatctgtggtggaaagttccggcggtgcaggatgggcccgcggcctatcagcttgttggtggggtagtggcctaccaaggcgacgacgggtagccggcctgagagggcgaccggccacactgggactgagacacggcccagactcctacgggaggcagcagtggggaatattgcgcaatgggcgaaagcctgacgcagcgacgccgcgtgagggatgacggccttcgggttgtaaacctctttcagcagggacgaagcgcgagtgacggtacctgcagaagaagcaccggctaactacgtgccagcagccgcggtaatacgtagggtgcgagcgttgtccggaattattgggcgtaaagagctcgtaggcggtttgtcgcgtcgactgtgaaaacctacagcttaactgtgggcttgcagtcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacggtgggaactaggtgtggggggcttccacgtcctccgtgccgtagctaacgcattaagttccccgcctggggagtacggccgcaaggctaaaactcaaaggaattgacgggggcccgcacaagcggcggagcatgtggattaattcgatgcaacgcgaagaaccttacctgggcttgacatgcactggaaaccagtagagatattggcccccttgtggccggtgtacaggtggtgcatggctgtcgtcagctcgtgtcgtgagatgttgggttaagtcccgcaacgagcgcaaccctcgttccatgttgccagcgcgtaatggcggggactcatgggagactgccggggtcaactcggaggaaggtggggatgacgtcaagtcatcatgccccttatgtccagggcttcacacatgctacaatggccggtacaaagggctgctaagccgtgaggtggagcgaatcccataaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagcccgtggcccaacccgtaagggagggagcggtcgaaggtgggactggcgattgggacgaagtcgtaacaaggtagccgtaccggaaggtgcggctggatcacctcctttctaaggag

SEQ ID NO: 4564 - DNA, 1557 bp, Kyrpidia spormannii
  ref <308>: DATABASE ACCESSION NUMBER: NCBI ACCESSION: NZ_CP024955.1
  ref <309>: DATABASE ENTRY DATE: 2019-04-01
  ref <313>: RELEVANT RESIDUES IN SEQ ID NO: (1)..(1557)
aatcttttcacggagagtttgatcctggctcaggacgaacgctggcggcgtgcctaatacatgcaagtcgagcgggtcgcctcggggcttgccccggggaggccagcggcggacgggtgagtaacgcgtgggcaacctgtccggcagaccgggacaacgcctggaaacgggcgctaattccggataggcgcaaagggcgcatgctttttgcgggaaaggggaaacccgctgtcgggtgggcccgcgtcgcattagctggttggtggggtaacggctcaccaaggcgacgatgcgtagccggcctgagagggtgggcggccacactgggactgagacacggcccagactcctacgggaggcagcagtagggaatcttccgcaatgggcgaaagcctgacggagcgacgccgcgtgagggaagaaggccttcgggttgtaaacctctggctttggggacgagggcaccgaggggactcggtgagggacggtacccaaggaggaagccccggcaaactacgtgccagcagccgcggtaagacgtagggggcgagcgttgtccggaatcactgggcgtaaagggcgcgcaggcggcgatgcacgtccgaggtgaaaggcagcggctcaaccgctgaggggcctcggatacggcatggcttgagggtcggagaggcaaggggaattcctggtgtagcggtgaaatgcgtagagatcaggaggaataccggtggcgaaggcgccttgctggacgacacctgacgctgaggcgcgaaagcgtggggagcgaacaggattagataccctggtagtccacgccgtaaacgatgagtgctaggtgtgggtggggatgcccatccgtgccgaaggaaacccaataagcactccgcctggggagtacggccgcaaggctgaaactcaaaggaattgacgggggcccgcacaagcggtggagcatgtggtttaattcgaagcaacgcgaagaaccttaccagggcttgacatccctctgacaccttcagagatgaggggtttccttcggggacagaggagacaggtggtgcatggttgtcgtcagctcgtgtcgtgagatgttgggttaagtcccgcaacgagcgcaacccttgctctgtgttgccagcacgagaggtgggcactcacaggggactgccggcgaggagccggaggaaggcggggatgacgtcaaatcatcatgccccatatgtcctgggctacacacgtgctacaatgggcggtacaacggggagcgaaggggcgacctggagcgaatccctgaaagccgttcgtagttcggattgcaggctgcaactcgcctgcatgaaggcggaatcgctagtaatcgcggatcagcatgccgcggtgaatccgttcccgggccttgtacacaccgcccgtcacaccacgagagtcggcaacacccgaagtcggtggggcaaccgtccgagagggcggagccagccgccgaaggtggggtcgatgattggggtgaagtcgtaacaaggtagccgtatcggaaggtgcggctggatcacctcctttcta

SEQ ID NO: 4565 - DNA, 1538 bp, Kyrpidia tusciae
  ref <308>: DATABASE ACCESSION NUMBER: NCBI ACCESSION: NC_014098.1
  ref <309>: DATABASE ENTRY DATE: 2019-04-01
  ref <313>: RELEVANT RESIDUES IN SEQ ID NO: (1)..(1538)
ggagagtttgatcctggctcaggacgaacgctggcggcgtgcctaatacatgcaagtcgagcgggtctccccggggcttgccccggggagatcagcggcggacgggtgagtaacgcgtgggcaacctgtccgacagaccgggacaacgcctggaaacgggcgctaattccggataggcgccaggggcgcatgctcttggcgggaaaggggaaacccgctgtcgggtgggcccgcgtcgcattagctggttggtggggtaacggctcaccaaggcgacgatgcgtagccggcctgagagggtggacggccacactgggactgagacacggcccagactcctacgggaggcagcagtagggaatcttccgcaatgggcgaaagcctgacggagcgacgccgcgtgagggacgaaggccttcgggttgtaaacctctggctttggggacgagggcaccggggggacccggtgagggacggtacccaaggaggaagccccggcaaactacgtgccagcagccgcggtaagacgtagggggcgagcgttgtccggaatcactgggcgtaaagggcgcgcaggcggcgatgcacgtccgaggtgaaaggcagcggctcaaccgctgaggggcctcggatacggcatggcttgagggtcggagaggcaaggggaattcctggtgtagcggtgaaatgcgtagagatcaggaggaataccggtggcgaaggcgccttgctggacgacgcctgacgctgaggcgcgaaagcgtggggagcgaacaggattagataccctggtagtccacgccgtaaacgatgagtgctaggtgtgggtggggatgcccatccgtgccgaaggaaacccaataagcactccgcctggggagtacggccgcaaggctgaaactcaaaggaattgacgggggcccgcacaagcggtggagcatgtggtttaattcgaagcaacgcgaagaaccttaccagggcttgacatccctctgacaccttcagagatggggggttcccgtttgggacagaggagacaggtggtgcatggttgtcgtcagctcgtgtcgtgagatgttgggttaagtcccgcaacgagcgcaacccttgctctgtgttgccagcactctgggtgggcactcacaggggactgccggcgaggagccggaggaaggcggggatgacgtcaaatcatcatgccccatatgtcctgggctacacacgtgctacaatgggcggtacaacggggggcgaaggggcgacctggagcgaatccctgaaagccgttcgtggttcggattgcaggctgcaactcgcctgcatgaaggcggaatcgctagtaatcgcggatcagcatgccgcggtgaatccgttcccgggccttgtacacaccgcccgtcacaccacgagagtcggcaacacccgaagtcggtggggcaaccggaaggggccagccgccgaaggtggggtcgatgattggggtgaagtcgtaacaaggtagccgtatcggaaggtgcggctggatcacctcctttcta

SEQ ID NO: 4566 - DNA, 1529 bp, Labedella endophytica
  ref <308>: DATABASE ACCESSION NUMBER: NCBI ACCESSION: NZ_RZGZ01000002.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacggtgaaagagaagcttgcttctctggatcagtggcgaacgggtgagtaacacgtgagtaacctgcccttgactctgggataagcgttggaaacgacgtctaataccggatacgaaccgtggaggcatctcctgcggttggaaagaattttggtcaaggatggactcgcggcctatcaggtagttggtgaggtaacggctcaccaagccgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacgcgaggctcaacctcgcgcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtctggaaacagtcgccccgcaaggtcggtatacaggtggtgcatggttgtcgtcagctcgtgtcgtgagatgttgggttaagtcccgcaacgagcgcaaccctcgttctatgttgccagcacgtaatggtgggaactcatggaagactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaacccttgtggatggagctgtctaaggtgggattggtaattaggactaagtcgtaacaaggtagccgtaccggaaggtgcggctggatcacctcctttctaagga

SEQ ID NO: 4567 - DNA, 1529 bp, Labedella gwakjiensis
  ref <308>: DATABASE ACCESSION NUMBER: NCBI ACCESSION: NZ_RZGY01000001.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacggtgaaagaggagcttgctcctctggatcagtggcgaacgggtgagtaacacgtgagtaacctgcccttgactctgggataagcgttggaaacgacgtctaataccggatatgaaccgcgaaggcatcttctgcggttggaaagaattttggtcaaggatggactcgcggcctatcagctagttggtgaggtaacggcccaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacgcgaggctcaacctcgcgcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtctggaaacagtcgccccgcaaggtcggtatacaggtggtgcatggttgtcgtcagctcgtgtcgtgagatgttgggttaagtcccgcaacgagcgcaaccctcgttctatgttgccagcacgtaatggtgggaactcatggaagactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaacccttgtggaaggagctgtctaaggtgggatcggtaattaggactaagtcgtaacaaggtagccgtaccggaaggtgcggctggatcacctcctttctaagga

SEQ ID NO: 4568 - DNA, 1528 bp, Labedella sp. 11W25H-1
  ref <308>: DATABASE ACCESSION NUMBER: NCBI ACCESSION: NZ_RZNB01000001.1
  ref <309>: DATABASE ENTRY DATE: 2019-04-01
  ref <313>: RELEVANT RESIDUES IN SEQ ID NO: (1)..(1528)
tttacggagagtttgatcctggctcaggacgaacgctggcggcgtgcttaacacatgcaagtcgaacggtgaaagaggagcttgctcctctggatcagtggcgaacgggtgagtaacacgtgagtaacctgcccttgactctgggataagcgttggaaacgacgtctaataccggatatgaaccgtggaggcatctcctgcggttggaaagaacttcggtcaaggatggactcgcggcctatcagctagttggtgaggtaacggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacgcgaggctcaacctcgcgcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtctagaaatagtcgccccgcaaggtcggtatacaggtggtgcatggttgtcgtcagctcgtgtcgtgagatgttgggttaagtcccgcaacgagcgcaaccctcgttctatgttgccagcacgtaatggtgggaactcatggaagactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcccaaccttttggagggagctgtctaaggtgggatcggtaattaggactaagtcgtaacaaggtagccgtaccggaaggtgcggctggatcacctcctttctaagga

SEQ ID NO: 4569 - DNA, 1528 bp, Labedella sp. 8H24J-4-2
  ref <308>: DATABASE ACCESSION NUMBER: NCBI ACCESSION: NZ_RZNC01000001.1
  ref <309>: DATABASE ENTRY DATE: 2019-04-01
  ref <313>: RELEVANT RESIDUES IN SEQ ID NO: (1)..(1528)
tttacggagagtttgatcctggctcaggacgaacgctggcggcgtgcttaacacatgcaagtcgaacggtgaaagaggagcttgctcctctggatcagtggcgaacgggtgagtaacacgtgagtaacctgcccttgactctgggataagcgttggaaacgacgtctaataccggatacgaaccgtggaggcatctcctgcggttggaaagaacttcggtcaaggatggactcgcggcctatcaggtagttggtgaggtaacggctcaccaagccgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacgcgaggctcaacctcgcgcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacggctagaaatagtcgccccgcaaggtcggtatacaggtggtgcatggttgtcgtcagctcgtgtcgtgagatgttgggttaagtcccgcaacgagcgcaaccctcgttctatgttgccagcacgtaatggtgggaactcatggaagactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcccaaccttttggagggagctgtctaaggtgggatcggtaattaggactaagtcgtaacaaggtagccgtaccggaaggtgcggctggatcacctcctttctaagga

SEQ ID NO: 4570 - DNA, 1500 bp, Labrenzia aggregata
  ref <308>: DATABASE ACCESSION NUMBER: NCBI ACCESSION: NZ_CP019630.1
  ref <309>: DATABASE ENTRY DATE: 2019-04-01
  ref <313>: RELEVANT RESIDUES IN SEQ ID NO: (1)..(1500)
ctttttagttaaacctgagagtttgatcctggctcagaacgaacgctggcggcaggcttaacacatgcaagtcgaacgaactcttcggagttagtggcagacgggtgagtaacgcgtgggaacctacctttaggtacggaacaacagttggaaacgactgctaataccgtatgtgccctatgggggaaagatttatcgcctaaggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggacttttaagtcaggggtgaaatcccggggctcaaccccggaactgcctttgatactggaagtcttgagtccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagccgtcaggtagcatgctatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctacttccagagatggaaggttcccttcggggacgccaggacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacagtgggcagcgaactcgcgagagggagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggcagtgcgctaaccgcaagggggcagctgaccacggtaggctcagcgactggggtgaagtcgtaacaaggtagccctaggggaacctggggctggatcacctcctttctaagga

SEQ ID NO: 4571 - DNA, 1492 bp, Labrenzia alba
  ref <308>: DATABASE ACCESSION NUMBER: NCBI ACCESSION: NZ_CXWC01000008.1
  ref <309>: DATABASE ENTRY DATE: 2019-04-01
  ref <313>: RELEVANT RESIDUES IN SEQ ID NO: (1)..(1492)
ttaaacctgagagtttgatcctggctcagaacgaacgctggcggcaggcttaacacatgcaagtcgaacgaactcttcggagttagtggcagacgggtgagtaacgcgtgggaacctacctttaggtacggaacaacagttggaaacgactgctaataccgtatgagccctatgggggaaagatttatcgcctaaggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggacttttaagtcaggggtgaaatcccggggctcaaccccggaactgcctttgatactggaagtcttgagaccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagccgtcaggtagcatgctatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctacatcgggagaccgatggttcccttcggggacgccaggacaggtgctgcatggctgtcgtcagctcgtgtcgtgagatgttgggttaagtcccgcaacgagcgcaaccctcgcccttagttgccagcattaagttgggcactctagggggactgccggtgataagccgagaggaaggtggggatgacgtcaagtcctcatggcccttacgggctgggctacacacgtgctacaatggcggtgacagtgggcagcgaacccgcaagggggagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggcagtgcgctaaccgtaagggggcagctgaccacggtaggctcagcgactggggtgaagtcgtaacaaggtagccctaggggaacctggggctggatcacctcctttctaagga

SEQ ID NO: 4572 - DNA, 1490 bp, Labrenzia alexandrii
  ref <308>: DATABASE ACCESSION NUMBER: NCBI ACCESSION: NZ_CXWD01000047.1
  ref <309>: DATABASE ENTRY DATE: 2019-04-01
  ref <313>: RELEVANT RESIDUES IN SEQ ID NO: (1)..(1490)
caacctgagagtttgatcctggctcagaacgaacgctggcggcaggcttaacacatgcaagtcgaacgaactcttcggagttagtggcagacgggtgagtaacgcgtgggaatatacctttcggtacggaacaacagttggaaacgactgctaataccgtatgcgccctacgggggaaagatttatcgccgaaggattagcccgcgttggattagctagttggtggggtaaaggcctaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaataactgggcgtaaagcgcacgtaggcggacttttaagtcaggggtgaaatcccagagctcaactctggaactgcctttgatactggaagtcttgagtccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagttgtcaggcagcatgctgtttggtgacgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctacatccggagacggatggttcccttcggggacgccaggacaggtgctgcatggctgtcgtcagctcgtgtcgtgagatgttgggttaagtcccgcaacgagcgcaaccctcgcccttagttgccagcatttagttgggcactctagggggactgccggtgataagccgagaggaaggtggggatgacgtcaagtcctcatggcccttacgggctgggctacacacgtgctacaatggcggtgacaatgggcagcgaacccgcgagggggagctaatctcaaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggcagtgcgctaaccgtaagggggcagctgaccacggtaggctcagcgactggggtgaagtcgtaacaaggtagccctaggggaacctggggctggatcacctcctttctaagga

SEQ ID NO: 4573 - DNA, 1489 bp, Labrenzia marina
  ref <308>: DATABASE ACCESSION NUMBER: NCBI ACCESSION: NZ_PPCN01000024.1
  ref <309>: DATABASE ENTRY DATE: 2019-04-01
  ref <313>: RELEVANT RESIDUES IN SEQ ID NO: (1)..(1489)
caacctgagagtttgatcctggctcagaacgaacgctggcggcaggcttaacacatgcaagtcgaacgaactcttcggagttagtggcagacgggtgagtaacgcgtgggaacatacctttcggtacggaacaacagttggaaacgactgctaataccgtatgcgccctatgggggaaagatttatcgccgagagattggcccgcgttggattagctagttggtggggtaacggcctaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggacttttaagtcaggggtgaaatcccggggctcaaccccggaactgcctttgatactggaagtcttgagaccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaactatggaagctagccgtcaggtagcatgctatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctacatcgggagaccgatggttcccttcggggacgccaggacaggtgctgcatggctgtcgtcagctcgtgtcgtgagatgttgggttaagtcccgcaacgagcgcaaccctcgcccttagttgccagcattaagttgggcactctagggggactgccggtgataagccgagaggaaggtggggatgacgtcaagtcctcatggcccttacgggctgggctacacacgtgctacaatggcggtgacagtgggcagcgaactcgcgagagggagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggcagtgcgctaaccgcaagggggcagctgaccacggtaggctcagcgactggggtgaagtcgtaacaaggtagccctaggggaacctggggctggatcacctcctttctaagg

SEQ ID NO: 4574 - DNA, 1488 bp, Labrenzia sp. 011
  ref <308>: DATABASE ACCESSION NUMBER: NCBI ACCESSION: NZ_QCYM01000043.1
  ref <309>: DATABASE ENTRY DATE: 2019-04-01
  ref <313>: RELEVANT RESIDUES IN SEQ ID NO: (1)..(1488)
caacctgagagtttgatcctggctcagaacgaacgctggcggcaggcttaacacatgcaagtcgaacgaactcttcggagttagtggcagacgggtgagtaacgcgtgggaacctacctttaggtacggaacaacagttggaaacgactgctaataccgtatgtgccctatgggggaaagatttatcgcctaaggatgggcccgcgttggattagctagttggtggggtaatggcctaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggactgatcagtcaggggtgaaatcccggggctcaaccccggaactgcctttgatactgtcagtcttgagaccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagccgtcaggtagcatgctatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctagatcgggagaccgattgttcccttcggggacgccaggacaggtgctgcatggctgtcgtcagctcgtgtcgtgagatgttgggttaagtcccgcaacgagcgcaaccctcgcccttagttgccagcattaagttgggcactctagggggactgccggtgataagccgagaggaaggtggggatgacgtcaagtcctcatggcccttacgggctgggctacacacgtgctacaatggcggtgacagtgggcagcgaactcgcgagagggagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggcagtgcgctaaccgcaaggaggcagctgaccacggtaggctcagcgactggggtgaagtcgtaacaaggtagccctaggggaacctggggctggatcacctcctttctaag

SEQ ID NO: 4575 - DNA, 1485 bp, Labrenzia sp. Alg231-36
  ref <308>: DATABASE ACCESSION NUMBER: NCBI ACCESSION: NZ_FREW01000004.1
  ref <309>: DATABASE ENTRY DATE: 2019-04-01
  ref <313>: RELEVANT RESIDUES IN SEQ ID NO: (1)..(1485)
aacctgagagtttgatcctggctcagaacgaacgctggcggcaggcttaacacatgcaagtcgaacgaactcttcggagttagtggcagacgggtgagtaacgcgtgggaacctacctttaggtacggaacaacagttggaaacgactgctaataccgtatgagccctatgggggaaagatttatcgcctaaggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggacttttaagtcaggggtgaaatcccggggctcaaccccggaactgcctttgatactggaagtcttgagaccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagccgtcaggtagcatgctatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctacatcgggagaccgatggttcccttcggggacgccaggacaggtgctgcatggctgtcgtcagctcgtgtcgtgagatgttgggttaagtcccgcaacgagcgcaaccctcgcccttagttgccagcattaagttgggcactctagggggactgccggtgataagccgagaggaaggtggggatgacgtcaagtcctcatggcccttacgggctgggctacacacgtgctacaatggcggtgacagtgggcagcgaacccgcaagggggagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggcagtgcgctaaccgtaagggggcagctgaccacggtaggctcagcgactggggtgaagtcgtaacaaggtagccctaggggaacctggggctggatcacctcctttcta

SEQ ID NO: 4576 - DNA, 1500 bp, Labrenzia sp. C1B10; identical to SEQ ID NO: 4570
  ref <308>: DATABASE ACCESSION NUMBER: NCBI ACCESSION: NZ_AXBY01000028.1
  ref <309>: DATABASE ENTRY DATE: 2019-04-01
  ref <313>: RELEVANT RESIDUES IN SEQ ID NO: (1)..(1500)

SEQ ID NO: 4577 - DNA, 1500 bp, Labrenzia sp. C1B70; identical to SEQ ID NO: 4570
  ref <308>: DATABASE ACCESSION NUMBER: NCBI ACCESSION: NZ_AXCE01000019.1
  ref <309>: DATABASE ENTRY DATE: 2019-04-01
  ref <313>: RELEVANT RESIDUES IN SEQ ID NO: (1)..(1500)

SEQ ID NO: 4578 - DNA, 1500 bp, Labrenzia sp. CP4; identical to SEQ ID NO: 4570
  ref <308>: DATABASE ACCESSION NUMBER: NCBI ACCESSION: NZ_CP011927.1
  ref <309>: DATABASE ENTRY DATE: 2019-04-01
  ref <313>: RELEVANT RESIDUES IN SEQ ID NO: (1)..(1500)

SEQ ID NO: 4579 - DNA, 1492 bp, Labrenzia sp. DG1229
  ref <308>: DATABASE ACCESSION NUMBER: NCBI ACCESSION: NZ_KI928933.1
  ref <309>: DATABASE ENTRY DATE: 2019-04-01
  ref <313>: RELEVANT RESIDUES IN SEQ ID NO: (1)..(1492)
ttaaacctgagagtttgatcctggctcagaacgaacgctggcggcaggcttaacacatgcaagtcgaacgagctcttcggagttagtggcagacgggtgagtaacgcgtgggaacctacctttaggtacggaacaacagttggaaacgactgctaataccgtatgagccctatgggggaaagatttatcgcctaaggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggacttttaagtcaggggtgaaatcccggggctcaaccccggaactgcctttgatactggaagtcttgagaccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagccgtcaggtagcatgctatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctacatcgggagaccgatggttcccttcggggacgccaggacaggtgctgcatggctgtcgtcagctcgtgtcgtgagatgttgggttaagtcccgcaacgagcgcaaccctcgcccttagttgccagcattaagttgggcactctagggggactgccggtgataagccgagaggaaggtggggatgacgtcaagtcctcatggcccttacgggctgggctacacacgtgctacaatggcggtgacagtgggcagcgaacccgcaagggggagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggcagtgcgctaaccgtaagggggcagctgaccacggtaggctcagcgactggggtgaagtcgtaacaaggtagccctaggggaacctggggctggatcacctcctttctaagga

SEQ ID NO: 4580 - DNA, 1485 bp, Labrenzia sp. EL143; identical to SEQ ID NO: 4575
  ref <308>: DATABASE ACCESSION NUMBER: NCBI ACCESSION: NZ_OGUZ01000004.1
  ref <309>: DATABASE ENTRY DATE: 2019-04-01
  ref <313>: RELEVANT RESIDUES IN SEQ ID NO: (1)..(1485)

SEQ ID NO: 4581 - DNA, 1371 bp, Labrenzia sp. OB1
  ref <308>: DATABASE ACCESSION NUMBER: NCBI ACCESSION: NZ_JSEP01000005.1
  ref <309>: DATABASE ENTRY DATE: 2019-04-01
  ref <313>: RELEVANT RESIDUES IN SEQ ID NO: (1)..(1371)
tttggtacggaacaacagttggaaacgactgctaataccgtatgcgccctatgggggaaagatttatcgccgagagattggcccgcgttggattagctagttggtggggtaatggcctaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggacttttaagtcaggggtgaaatcccggggctcaaccccggaactgcctttgatactggaagtcttgagaccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagccgtcaggtagcatgctatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctacatcgggagaccgatggttcccttcggggacgccaggacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacagtgggcagcgaactcgcgagagggagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggcagtgcgctaaccgcaagggggcagctgaccacggtaggctcagcgactggggtgaagtcgtaacaaggtagccctaggggaacctggggctggatcacctcctttctaagga

SEQ ID NO: 4582 - DNA, 1492 bp, Labrenzia suaedae
  ref <308>: DATABASE ACCESSION NUMBER: NCBI ACCESSION: NZ_FRBW01000012.1
  ref <309>: DATABASE ENTRY DATE: 2019-04-01
  ref <313>: RELEVANT RESIDUES IN SEQ ID NO: (1)..(1492)
ttaaacctgagagtttgatcctggctcagaacgaacgctggcggcaggcttaacacatgcaagtcgaacggtctcttcggagatagtggcagacgggtgagtaacgcgtgggaacatacctttcggtacggaacaacagttggaaacgactgctaataccgtatacgccctatgggggaaagatttatcgccgagagattggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggacttttaagtcaggggtgaaatcccggggctcaaccctggaactgcctttgatactggaagtcttgagtccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagccgtcaggttgcatgcaatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatttggtgctacatcgagagatcgatggttcccttcggggacgccaggacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacaatgggcagcgaacccgcgagggggagctaatctcaaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttggttttacccgaaggcgctgcgctaaccgcaaggaggcaggcgaccacggtagggtcagcgactggggtgaagtcgtaacaaggtagccctaggggaacctggggctggatcacctcctttctaagga

SEQ ID NO: 4583 - DNA, 1495 bp, Labrys sp. WJW
  ref <308>: DATABASE ACCESSION NUMBER: NCBI ACCESSION: NZ_LYXZ01000028.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgaacgcatccttcggggtgagtggcagacgggtgagtaacgcgtggggatgtgccttgaggtggggaataactgtgggaaactacagctaataccgcataagcccttcgggggaaagatttatcgcctttagagcaacccgcgtcagattagctagttggtagggtaatggcctaccaaggcgacgatctgtagctggtctgagaggatgaccagccacactgggactgagacacggcccagactcctacgggaggcagcagtggggaatattggacaatgggcgcaagcctgatccagccatgccgcgtgagtgatgacggccttagggttgtaaagctcttttaacagggacgataatgacggtacctgtagaataagccccggcaaacttcgtgccagcagccgcggtaatacgaagggggctagcgttgttcggaattactgggcgtaaagcgcacgtaggcggattgttaagtcgggggtgaaatcctgaggctcaacctcagaactgccttcgatactggcgatcttgagttcggaagaggttggtggaacagctagtgtagaggtgaaattcgtagatattagctagaacaccagtggcgaaggcggccaactggtccgatactgacgctgaggtgcgaaagcgtggggagcaaacaggattagataccctggtagtccacgccgtaaacgatgaatgccagccgtcggggagcttgctcttcggtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcccttgacatcccggtcgcggatcacagagatgagatccttcagttcggctggaccggagacaggtgctgcatggctgtcgtcagctcgtgtcgtgagatgttgggttaagtcccgcaacgagcgcaaccctcgcccctagttgccagcattgagttgggcactctagggggactgccggtgataagccgcgaggaaggtggggatgacgtcaagtcctcatggcccttacgggctgggctacacacgtgctacaatggcggtgacagtgggaagcgaaggggtgacccctagcaaatctccaaaagccgtctcagttcagattgcactctgcaactcgagtgcatgaaggtggaatcgctagtaatcgcagatcagcatgctgcggtgaatacgttcccgggccttgtacacaccgcccgtcacaccatgggagttggttttacccgaaggcgctgcgccaaccgcaaggaggcaggcgaccacggtagggtcagcgactggggtgaagtcgtaacaaggtagccgtaggggaacctgcggctggatcacctcctttctaagg

SEQ ID NO: 4584 - DNA, 1648 bp, Lachnoanaerobaculum sp. KCOM 2030
  ref <308>: DATABASE ACCESSION NUMBER: NCBI ACCESSION: NZ_RRCO01000002.1
  ref <309>: DATABASE ENTRY DATE: 2019-04-01
  ref <313>: RELEVANT RESIDUES IN SEQ ID NO: (1)..(1648)
ttatatgagagtttgatcctggctcaggatgaacgctggcggcgtgcttaacacatgcaagtcgaacgaagctgcctggaggaagttttcggatggaatttaggtagacttagtggcggacgggtgagtaacgcgtggataacctgccttatacagggggataacggagagaaatttccgctaagaccgcataagaccacagcaccgcatggtgcaggggtaaaatatttataggtataagatggatccgcgtccgattagctagttggtgaggtaaaggcccaccaaggcgacgatcggtagccggcctgagagggtgaacggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcagacggcaatgcaagtctgaagtgaaaggcgtgggctcaacccatgaactgctttggaaactgtatagcttgagtgtcggaggggtaagcggaattcctagtgtagcggtgaaatgcgtagatattaggaggaacaccggaggcgaaggcggcttactggacgacaactgacgttgaggctcgaaggcgtggggagcaaacaggattagataccctggtagtccacgcagtaaacgatgaatacttggtgtcggtgaggtaaactcatcggtgccgcaagctaacgcattaagtattccacctggggagtacgttcgcaagaatgaaactcaaaggaattgacggggacccgcacaagcggtggagcatgtggtttaattcgaagcaacgcgaagaaccttaccaaatcttgacatactcttgaatagttttgtaatgagactagaccttcgggacaagggatacaggtggtgcatggttgtcgtcagctcgtgtcgtgagatgttgggttaagtcccgcaacgagcgcaacccttgtcgtcagtagccagcagtaagatgggcactctgacgagacagccggagataatccggaggaaggtggggatgacgtcaaatcatcatgccctttatgatttgggctacacacgtgctacaatggcgtaaacaaagtgaagcaaagccgcgaggtcaagcaaatcacaaaaataacgtctcagttcggattgtagtctgcaactcgactatatgaagctggaatcgctagtaatcgcagatcagaatgctgcggtgaatacgttcccgggtcttgtacacaccgcccgtcacaccatgggagtcatcaatgcccgaagtcagtgacctaacccacactggtaaacataaagctgggataagaatacgagggaataagccgtaaggcttatgagtgagtattcttatatgatataaagaatagcagtagttatgtttagcagtgtgggaaggagctgccgaaggcagggaggataactggggtgaagtcgtaacaaggtagccgtatcggaaggtgcggctggatcacctcctttctaagga

SEQ ID NO: 4585 - DNA, 1543 bp, Lachnobacterium bovis
  ref <308>: DATABASE ACCESSION NUMBER: NCBI ACCESSION: NZ_FOGW01000003.1
  ref <309>: DATABASE ENTRY DATE: 2019-04-01
  ref <313>: RELEVANT RESIDUES IN SEQ ID NO: (1)..(1543)
ttttaaaatgagagtttgatcctggctcaggatgaacgctggcggcgtgcttaacacatgcaagtcgaacgaagcacattatttgaattcttcgggaggaagataatgcgactgagtggcggacgggtgagtaacgcgtgggtaacctgccatgtacagggggacaacagttggaaacggctgctaataccgcataagcgcacgagattgcatgatctagtgtgaaaaactccggtggtatatgatggacccgcgtctgattagctagttggtaaggtaacggcttaccaaggcgacgatcagtagccgacctgagagggtgaccggccacattgggactgagacacggcccagactcctacgggaggcagcagtggggaatattgcacaatgggcgaaagcctgatgcagcgacgccgcgtgaacgaagaagtatttcggtatgtaaagttctatcagcagggaagaaaaaatgacggtacctgactaagaagccccggctaactacgtgccagcagccgcggtaatacgtagggggcaagcgttatccggatttactgggtgtaaagggagcgcaggcggcccggcaagtctgatgtgaaaacccaaggctcaaccatgggattgcattggaaactgtcgagctagagtatcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggtgttatgaacattcggtgccggcgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccaatgacaagctatgtaatgtagcctctcttcggagcattggagacaggtggtgcatggttgtcgtcagctcgtgtcgtgagatgttgggttaagtcccgcaacgagcgcaacccttgtccttagtagccagcagtaagatgggcactctagggagactgccagggataacctggaggaaggtggggatgacgtcaaatcatcatgccccttatgacttgggctacacacgtgctacaatggcgtaaacaaagtgaagcgagatggtgacattaagcaaatcacaaaaataacgtctcagttcggactgtagtctgcaactcgactacacgaagctggaatcgctagtaatcgcagatcagaatgctgcggtgaatacgttcccgggtcttgtacacaccgcccgtcacaccatgggagttggtaatgcccgaagccggtgacctaaccgtaaggaaggagccgtcgaaggcaggatcgataactggggtgaagtcgtaacaaggtagccgtatcggaaggtgcggctggatcacctcctttctaaggaa

SEQ ID NO: 4586 - DNA, 1538 bp, Lachnoclostridium phytofermentans
  ref <308>: DATABASE ACCESSION NUMBER: NCBI ACCESSION: NZ_JPOF01000004.1
  ref <309>: DATABASE ENTRY DATE: 2019-04-01
  ref <313>: RELEVANT RESIDUES IN SEQ ID NO: (1)..(1538)
tttaatttgagagtttgatcctggctcaggatgaacgctggcggcgtgcttaacacatgcaagtcgaacggagtttttaaacggaagtcctcggatggaagtttaaaaacttagtggcggacgggtgagtaacgcgtgggtaacctgcctcatacaggggggataacagtcggaaacgattgctaacaccgcataatatagcgaaaccgcatgattttgctatcaaatatttataggtatgagatgggcccgcgtctgattagctagttggtggggtaaaggcctaccaaggcgacgatcagtagccggcttgagagagtgaccggccacattgggactgagacacggcccaaactcctacgggaggcagcagtggggaatattggacaatgggggcaaccctgatccagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtaggtggtaggtcaagtcagatgtgaaagcccagggctcaaccctgggactgcatttgaaactggcatactagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactagctgtcggggctatcatggcttcggtggcgcagctaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgacaaccgagtaacgtcggtcttccttcgggacagaggtgacaggtggtgcatggttgtcgtcagctcgtgtcgtgagatgttgggttaagtcccgcaacgagcgcaacccctatctttagtagccagcatttaaggtgggcactctagagagactgccagggataacctggaggaaggcggggatgacgtcaaatcatcatgccccttatgatttgggctacacacgtgctacaatggtgactacaaagagaagcgagcctgcgagggggagcaaatctcagaaaggtcatcccagttcggattgtactctgcaactcgagtacatgaagctggaatcgctagtaatcgcgaatcagaatgtcgcggtgaatacgttcccgggtcttgtacacaccgcccgtcacaccatgggagtaggtaacgcccgaagtcagtgacccaaccgtaaggagggagctgccgaaggcgggatctataactggggtgaagtcgtaacaaggtagccgtatcggaaggtgcggctggatcacctcctttctaag

SEQ ID NO: 4587 - DNA, 1323 bp, Lachnoclostridium sp. SNUG30386
  ref <308>: DATABASE ACCESSION NUMBER: NCBI ACCESSION: NZ_PYLO01000012.1
  ref <309>: DATABASE ENTRY DATE: 2019-04-01
  ref <313>: RELEVANT RESIDUES IN SEQ ID NO: (1)..(1323)
gtgtgaaaaactccggtggtgtgagatggacccgcgtttgattagctagttggtggggtaacggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccggggctcaaccccgggactgctttggaaactgtttaactagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgttgggggacaaagtccttcggtgccgtcgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaccggcgagtaatgtcgcctttccttcgggacagaggagacaggtggtgcatggttgtcgtcagctcgtgtcgtgagatgttgggttaagtcccgcaacgagcgcaacccttatcctaagtagccagcagttcggctgggcactcttgggagactgccagggataacctggaggaaggtggggatgacgtcaaatcatcatgccccttatgatttgggctacacacgtgctacaatggcgtaaacaaagagaggcgagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaatgcccgaagtcagtgacccaaccgwaaggagggagctgccgaaggcaggaccgataactggggtgaagtcgtaacaaggtagccgtatcggaaggtgcggctggatcacctcctttctaaggaa

SEQ ID NO: 4588 - DNA, 1543 bp, Lachnoclostridium sp. YL32
  ref <308>: DATABASE ACCESSION NUMBER: NCBI ACCESSION: NZ_CP015399.2
  ref <309>: DATABASE ENTRY DATE: 2019-04-01
  ref <313>: RELEVANT RESIDUES IN SEQ ID NO: (1)..(1543)
tttgaacatgagagtttgatcctggctcaggatgaacgctggcggcgtgcctaacacatgcaagtcgaacgaagcgattaagatgaagttttcggatggaatcttgattgactgagtggcggacgggtgagtaacgcgtggataacctgcctcacactgggggataacagttagaaatgactgctaataccgcataagcgcacagtgccgcatggcagtgtgtgaaaaactccggtggtgtgagatggatccgcgtctgattagccagttggcggggtaacggcccaccaaagcgacgatcagtagccggcctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgccgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatccccctggcgggccggtaacgcggcctttccttcgggacaggggagacaggtggtgcatggttgtcgtcagctcgtgtcgtgagatgttgggttaagtcccgcaacgagcgcaacccttatccttagtagccagcacgtgaaggtgggcactctagggagactgccagggataacctggaggaaggtggggatgacgtcaaatcatcatgccccttatgatttgggctacacacgtgctacaatggcgtaaacaaagggaagcgagacagtgatgcggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaa

SEQ ID NO: 4589 - DNA, 1081 bp, Lachnospira multipara
  ref <308>: DATABASE ACCESSION NUMBER: NCBI ACCESSION: NZ_FNUL01000035.1
  ref <309>: DATABASE ENTRY DATE: 2019-04-01
  ref <313>: RELEVANT RESIDUES IN SEQ ID NO: (1)..(1081)
agggaagataatgacggtacctgactaagaagctccggctaaatacgtgccagcagccgcggtaatacgtatggagcaagcgttatccggatttactgggtgtaaagggagtgtaggtggcaaagcaagtcagtagtgaaaatccggggctcaacctcggaactgctattgaaactgtttagctagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgttgggtctcataagagattcggtgccgcagctaacgcaataagtattccacctggggagtacgttcgcaagaatgaaactcaaaggaattgacggggacccgcacaagcggtggagcatgtggtttaattcgaagcaacgcgaagaaccttacctagtcttgacatcccgatgaccaagtatgtaatgtactctttcttcggaacatcggtgacaggtggtgcatggttgtcgtcagctcgtgtcgtgagatgttgggttaagtcccgcaacgagcgcaacccctatttctagtagccagcagttcggctgggcactctagagagactgccagggataacctggaggaaggtggggatgacgtcaaatcatcatgccccttatgactagggctacacacgtgctacaatggcgtaaacaaagtgaagcgagagtgtgagcttaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgtaagaaggagccgccgaaggcaggtttgataactggggtgaagtcgtaacaaggtagccgtatcggaaggtgcggctggatcacctcctttctaaggaa

SEQ ID NO: 4590 - DNA, 1540 bp, Lachnospira pectinoschiza
  ref <308>: DATABASE ACCESSION NUMBER: NCBI ACCESSION: NZ_FNHZ01000012.1
  ref <309>: DATABASE ENTRY DATE: 2019-04-01
  ref <313>: RELEVANT RESIDUES IN SEQ ID NO: (1)..(1540)
tttttatgagagtttgatcctggctcaggatgaacgctggcggcgtgcttaacacatgcaagtcgaacgaagcaacttatcacgattccttcgggatgacgatttgttgactgagtggcggacgggtgagtaacgcgtgggtaacctgccttatacagggggatagcagctggaaacggctgataataccgcataagcgcacagcatcgcatgatgcagtgtgaaaaactccggtggtataagatggacccgcgtctgattagctagttggtgaggtaacggcccaccaaggcgacgatcagtagccgacctgagagggtgaccggccacattgggactgagacacggcccagactcctacgggaggcagcagtggggaatattgcacaatggaggaaactctgatgcagcgacgccgcgtgagcgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggagtgtaggtggcaaagcaagtcagtagtgaaaatccggggctcaacctcggaactgctattgaaactgtttagctagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgttgggtctcataagagattcggtgccgcagctaacgcaataagtattccacctggggagtacgttcgcaagaatgaaactcaaaggaattgacggggacccgcacaagcggtggagcatgtggtttaattcgaagcaacgcgaagaaccttacctagtcttgacatcccgatgaccaagtatgtaatgtactctttcttcggaacatcggtgacaggtggtgcatggttgtcgtcagctcgtgtcgtgagatgttgggttaagtcccgcaacgagcgcaacccctatttctagtagccagcagttcggctgggcactctagagagactgccagggataacctggaggaaggtggggatgacgtcaaatcatcatgccccttatgactagggctacacacgtgctacaatggcgtaaacaaagtgaagcgagagtgcgagcttaagcaaatcacaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgaaaatgcccgaagtcggtgacctaacgtaagaaggagccgccgaaggcaggtttgataactggggtgaagtcgtaacaaggtagccgtatcggaaggtgcggctggatcacctcctttctaaggaa

SEQ ID NO: 4591 - DNA, 1552 bp, Lachnospiraceae bacterium 10-1
  ref <308>: DATABASE ACCESSION NUMBER: NCBI ACCESSION: NZ_KE159810.1
  ref <309>: DATABASE ENTRY DATE: 2019-04-01
  ref <313>: RELEVANT RESIDUES IN SEQ ID NO: (1)..(1552)
aaacatgagagtttgatcctggctcaggatgaacgctggcggcgtgcctaacacatgcaagtcgaacggagccttaaccaaagaagcagccagcttgctggaagcggaaaagggaaaggcttagtggcggacgggtgagtaacgcgtgggtaacctggcccatacagggggataacacttagaaataggtgctaataccgcataacaacagaaagcgcatgctttttgtttgaaaaccaaggtggtatgggatggacccgcgtctgattagctggttggcggggtaaaggcccaccaaggcgacgatcagtagccggcctgagagggtggacggccacattgggactgagacacggcccaaactcctacgggaggcagcagtggggaatattgcacaatgggggaaaccctgatgcagcgacgccgcgtgagtgaagaagtaattcgttatgtaaagctctatcagcagggaagaaaatgacggtacctgagtaagaagccccggctaactacgtgccagcagccgcggtaatacgtagggggcaagcgttatccggatttactgggtgtaaagggagcgtagacggcagtgcaagtctggagtgaaaggcgggggctcaacccccggactgctctggaaactgtacggctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgatcactaggtgtcgggggttaaagaaccttcggtgccgcagccaacgcagtaagtgatccacctggggagtacgttcgcaagaatgaaactcaaaggaattgacggggacccgcacaagcggtggagcatgtggtttaattcgaagcaacgcgaagaaccttaccaggccttgacatccccctgaatgggtggtaatgcatccagcccttcggggcaggggagacaggtggtgcatggttgtcgtcagctcgtgtcgtgagatgttgggttaagtcccgcaacgagcgcaacccctatccttagtagccagcgagcaagacgggcactctagggagactgccggggataacccggaggaaggtggggatgacgtcaaatcatcatgccccttatggcctgggctacacacgtgctacaatggcgtaaacaaagggaagcgaaggcgtgagcgtaagcaaaacccaaaaataacgtcccagttcggattgtagtctgcaacccgactacatgaagctggaatcgctagtaatcgcggatcagaatgccgcggtgaatacgttcccgggtcttgtacacaccgcccgtcacaccatgggagtcggaaatgcccgaagtcggtgacccaacctgaaagggagggagccgccgaaggcaggtctggtgactggggtgaagtcgtaacaaggtagccgtatcggaaggtgcggctggatcacctcctttctagggaa

SEQ ID NO: 4592 - DNA, 1542 bp, Lachnospiraceae bacterium 3-1
  ref <308>: DATABASE ACCESSION NUMBER: NCBI ACCESSION: NZ_KE159571.1
  ref <309>: DATABASE ENTRY DATE: 2019-04-01
  ref <313>: RELEVANT RESIDUES IN SEQ ID NO: (1)..(1542)
ttattatgagagtttgatcctggctcaggatgaacgctggcggcgtgcctaacacatgcaagtcgaacgaagcgcttttttggaagcttttcggagcggaagaggaagcgactgagtggcggacgggtgagtaacgcgtgggcaacctaccccacacagggggacaacagctggaaacggctgctaataccgcataggcgcacagcttcgcatgaaggagtgtggaaagcaatggcggtgtgggatgggcccgcgtctgattagctagttggtgaggcagaggctcaccaaggcgacgatcagtagccggcctgagagggcggacggccacattgggactgagacacggcccagactcctacgggaggcagcagtgggggatattgcacaatggggggaaccctgatgcagcgacgccgcgtgagcgaagaagtatttcggtatgtaaagctctatcagcagggaagaaaatgacggtacctgagtaagaagccccggctaaatacgtgccagcagccgcggtaatacgtatggggcaagcgttatccggatttactgggtgtaaagggagcgtaggcggcctggcaagtctgatgtgaaataccggggcccaaccccggggctgcattggaaactgtcaggctggagtgtcggagaggcaggcggaattcctagtgtagcggtgaaatgcgtagatattaggaggaacaccagtggcgaaggcggcctgctggacgatgactgacgctgaggctcgaaagcgtggggagcaaacaggattagataccctggtagtccacgccgtaaacgatgaatactaggtgtcggggggcaaggcgccccggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaggccttgacatccctctgaacgcatatgcaatgtatgttcccttcggggcagaggagacaggtggtgcatggttgtcgtcagctcgtgtcgtgagatgttgggttaagtcccgcaacgagcgcaacccttaccctcagtagccagcaagagagatgggcactctgtggggactgccagggacaacctggaggaaggcggggatgacgtcaaatcatcatgccccttatggcctgggctacacacgtgctacaatggcgtaaacaaagggaagcgagatggtgacatggagcgaaccccaaaaataacgtctcagttcggattgcagcctgcaactcggctgcatgaagctggaatcgctagtaatcgcggatcagaatgccgcggtgaatacgttcccgggtcttgtacacaccgcccgtcacaccatgggagccgggaatgcccgaagtcagtggcccaaccgcaaggagggagctgccgaaggcaggctcggtgactggggtgaagtcgtaacaaggtagccgtatcggaaggtgcggctggatcacctcctttctaaggaa

SEQ ID NO: 4593 - DNA, 1542 bp, Lachnospiraceae bacterium 3-2
  ref <308>: DATABASE ACCESSION NUMBER: NCBI ACCESSION: NZ_KE159795.1
  ref <309>: DATABASE ENTRY DATE: 2019-04-01
  ref <313>: RELEVANT RESIDUES IN SEQ ID NO: (1)..(1542)
tttatacgagagtttgatcctggctcaggatgaacgctggcggcgtgcttaacacatgcaagtcgagcgaagcactttgttttgaatcttcggaggaagaacgaagtgactgagcggcggacgggtgagtaacgcgtgggcaacctgcctcatacagggggataacagttagaaatgactgctaataccgcataagaccacggtactgcatggtacagtggtaaaaactccggtggtatgagatgggcccgcgtctgattagctagttggtgaggtaacggctcaccaaggcaacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgtatagctagagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggcagcaaagctgttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgaccttgacatcccgatgaccgtccagtaatgtgggcttcccttcggggcattggagacaggtggtgcatggttgtcgtcagctcgtgtcgtgagatgttgggttaagtcccgcaacgagcgcaacccctatctttagtagccagcacgtaatggtgggcactctagagagactgccagggacaacctggaggaaggtggggatgacgtcaaatcatcatgccccttatggccagggctacacacgtgctacaatggcgtaaacaaagggaagcgagaccgtgaggtggagcaaatcccagaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccaaataggagggagctgccgaaggtgggaccgataactggggtgaagtcgtaacaaggtagccgtatcggaaggtgcggctggatcacctcctttctaaggaa

SEQ ID NO: 4594 - DNA, 1540 bp, Lachnospiraceae bacterium 3 1 57FAA CT1
  ref <308>: DATABASE ACCESSION NUMBER: NCBI ACCESSION: NZ_KE150406.1
  ref <309>: DATABASE ENTRY DATE: 2019-04-01
  ref <313>: RELEVANT RESIDUES IN SEQ ID NO: (1)..(1540)
ttaaacaagagagtttgatcctggctcaggatgaacgctggcggcgtgcctaacacatgcaagtcgaacgaagttacacggaggaagttttcggatggaatcggtataacttagtggcggacgggtgagtaacgcgtgggaaacctgccctgtaccgggggataacacttagaaataggtgctaataccgcataagcgcacggaaccgcatggttccgtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaaacccagggctcaaccttgggattgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatccccctgaatatcttgtaaaaaagagatgccttcgggacaggggagacaggtggtgcatggttgtcgtcagctcgtgtcgtgagatgttgggttaagtcccgcaacgagcgcaacccttattcttagtagccagcaggtaaggctgggcactctaaggagactgccggggataacccggaggaaggcggggatgacgtcaaatcatcatgccccttatgatttgggctacacacgtgctacaatggcgtaaacaaagggaagcgagacagtgatgtggagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagtctgtgacctaaccgaaagggaggagcagccgaaggcaggtctgataactggggtgaagtcgtaacaaggtagccgtatcggaaggtgcggctggatcacctcctttctaagg

SEQ ID NO: 4595 - DNA, 1543 bp, Lachnospiraceae bacterium 5 1 57FAA
  ref <308>: DATABASE ACCESSION NUMBER: NCBI ACCESSION: NZ_GL945251.1
  ref <309>: DATABASE ENTRY DATE: 2019-04-01
  ref <313>: RELEVANT RESIDUES IN SEQ ID NO: (1)..(1543)
tttaacgagagtttgatcctggctcaggatgaacgctggcggcgtgcctaacacatgcaagtcgaacgaagcgcctggccccgacttcttcggaacgaggagccttgcgactgagtggcggacgggtgagtaacgcgtgggcaacctgccttgcactgggggataacagccagaaatggctgctaataccgcataagaccgaagcgccgcatggcgcggcggccaaagccccggcggtgcaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcgatgcaagccagatgtgaaagcccggggctcaaccccgggactgcatttggaactgcgtggctggagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggtggcaaggccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgatgccaaagcgcgtaacgcgctctttcttcggaacatcggtgacaggtggtgcatggttgtcgtcagctcgtgtcgtgagatgttgggttaagtcccgcaacgagcgcaacccctatcttcagtagccagcattatggatgggcactctggagagactgccagggagaacctggaggaaggtggggatgacgtcaaatcatcatgccccttatgaccagggctacacacgtgctacaatggcgtaaacaaagggaggcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacccaacccgtaagggagggagccgtcgaaggtgggaccgataactggggtgaagtcgtaacaaggtagccgtatcggaaggtgcggctggatcacctcctttctagggaa

SEQ ID NO: 4596 - DNA, 1541 bp, Lachnospiraceae bacterium 5 1 63FAA
  ref <308>: DATABASE ACCESSION NUMBER: NCBI ACCESSION: NZ_GL622435.1
  ref <309>: DATABASE ENTRY DATE: 2019-04-01
  ref <313>: RELEVANT RESIDUES IN SEQ ID NO: (1)..(1541)
gaacatgagagtttgatcctggctcaggatgaacgctggcggcgtgcttaacacatgcaagtcgaacgaaacaccttatttgattttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaa

SEQ ID NO: 4597 - DNA, 1539 bp, Lachnospiraceae bacterium A2
  ref <308>: DATABASE ACCESSION NUMBER: NCBI ACCESSION: NZ_KE159641.1
  ref <309>: DATABASE ENTRY DATE: 2019-04-01
  ref <313>: RELEVANT RESIDUES IN SEQ ID NO: (1)..(1539)
tttttatgagagtttgatcctggctcaggatgaacgctggcggcgtgcctaacacatgcaagtcgaacggggcgcggcggctgaggcttttcggagcggaagccggcgctgcccagtggcggacgggtgagtaacgcgtgggcaacctgccctgcactgggggacaacagccggaaacggctgctaataccgcatatgcccgcagccccgcatggggcggcgggggaagctccggcggtgcaggatgggcccgcgtctgattagctggttggcggggcaacggcccaccaaggcgacgatcagtagccggcctgagagggtgggcggccacattgggactgagacacggcccagactcctacgggaggcagcagtgggggatattgcacaatggggggaaccctgatgcagcgacgccgcgtgggcgatggagtgcttcggcatgtaaagccctatcagcagggaagaaaatgacggtacctgactaagaagccccggctaaatacgtgccagcagccgcggtaatacgtatggggcaagcgttatccggatttactgggtgtaaagggagcgtaggcggcctggcaagcctgatgtgaaataccggggcccaaccccggggctgcattgggaactgccaggctggagtgccggagaggcaggcggaattcctagtgtagcggtgaaatgcgtagatattaggaggaacaccagtggcgaaggcggcctgctggacggtgactgacgctgaggctcgaaagcgtggggagcaaacaggattagataccctggtagtccacgccgtaaacgatgaatactaggtgtcggcgggcaaagcccgccggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaggccttgacatcctgctgatggcatatgcaatgtatgttccctccggggcagcagagacaggtggtgcatggttgtcgtcagctcgtgtcgtgagatgttgggttaagtcccgcaacgagcgcaacccctgcccccagtagccagcgcgcaagggcgggcactctggggggactgccagggacaacctggaggaaggcggggatgacgtcaaatcatcatgccccttatggcctgggctacacacgtgctacaatggcgcccacaaagggaggcgaaatggcgacatggagcaaaccccagaaaaggcgccccagttcggattgcagcctgcaactcggctgcatgaagccggaatcgctagtaatcgcggatcagaatgccgcggtgaatacgttcccgggtcttgtacacaccgcccgtcacaccatgggagccgggaatgcccgaagtcagtggcccaaccgcaaggggggagttgccgaaggcaggcccggtgactggggtgaagtcgtaacaaggtagccgtatcggaaggtgcggctggatcacctcctttctaa

SEQ ID NO: 4598 - DNA, 1566 bp, Lachnospiraceae bacterium A4
  ref <308>: DATABASE ACCESSION NUMBER: NCBI ACCESSION: NZ_KE159538.1
  ref <309>: DATABASE ENTRY DATE: 2019-04-01
  ref <313>: RELEVANT RESIDUES IN SEQ ID NO: (1)..(1566)
tattttaacatgagagtttgatcctggctcaggatgaacgctggcggcgtgcttaacacatgcaagtcgaacggactcatattgaaacctagtgatgtatgagttagtggcggacgggtgagtaacgcgtggagaacctgccgtatactgggggataacacttagaaataggtgctaataccgcataagcgcacagcttcgcatgaagcagtgtggaaaacaaaaagctaaagcttttggtggtatacgatggatccgcgtctgattagcttgttggcggggtaaaggctcaccaaggcaacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtacgtaaagctctatcagcagggaagaaataaagtccttcggactttggacggtacctgactaagaagccccggctaactacgtgccagcagccgcggtaatacgtagggggcaagcgttatccggatttactgggtgtaaagggagcgtagacggcagcgcaagtctggagtgaaatcccatggcttaaccatggaactgctttggaaactgtgcagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgctgtaaacgatgattactaggtgttgggggaccaaggtccttcggtgccgtcgcaaacgcattaagtaatccacctggggagtacgttcgcaagaatgaaactcaaaggaattgacggggacccgcacaagcggtggagcatgtggtttaattcgaagcaacgcgaagaaccttacctggtcttgacatcccagtgacgcatgagtaaagtcatgtttccttcgggacactggagacaggtggtgcatggttgtcgtcagctcgtgtcgtgagatgttgggttaagtcccgcaacgagcgcaacccctatttccagtagccagcatgtaaagatgggcactctggagagactgcctaggataactaggaggaaggcggggatgacgtcaaatcatcatgccccttatgatcagggctacacacgtgctacaatggcgtaaacaaagggaagcgaagtggtgacgccaagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcagtgacctaaccgaaagggaggagctgccgaaggtggagccggtaactggggtgaagtcgtaacaaggtagccgtatcggaaggtgcggctggatcacctcctttctagggaa

SEQ ID NO: 4599 - DNA, 1557 bp, Lachnospiraceae bacterium AC2029
  ref <308>: DATABASE ACCESSION NUMBER: NCBI ACCESSION: NZ_JNLK01000001.1
  ref <309>: DATABASE ENTRY DATE: 2019-04-01
  ref <313>: RELEVANT RESIDUES IN SEQ ID NO: (1)..(1557)
ttttatttgagagtttgatcctggctcaggataaacgctggcggcgtgcttaacacatgcaagtcgaacggagtattcctcccgaagattgaagaagcttgcttctgattgattcatttggaatacttagtggcggacgggtgagtaacgcgtgggtaacctgcctcacactgggggatagcagttggaaacgactgataataccgcataagcacacagtaccgcatggtacagcgtgaaaaactccggtggtgtgagatggacccgcgtctgattagctagttggtgaggtaacggcccaccaaggcgacgatcagtagccggcctgagagggtgtacggccacattgggactgagacacggcccaaactcctacgggaggcagcagtggggaatattgcacaatgggggaaaccctgatgcagcgacgccgcgtgagtgatgaagtatctcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggcgcagtaagtcagaagtgaaaactatgggctcaacccatagactgcttttgaaactgccgcgctagagtgcaggagaggaaagtggaattcctagtgtagcggtggaatgcgtagatattaggaggaacaccagtggcgaaggcgactttctggactgttactgacactgaggcacgaaagcgtggggagcaaacaggattagataccctggtagtccacgccgtaaacgatgaatactaggtgttggggagcaaagctcttcggtgccgtcgctaacgcattaagtattccacctggggagtacgttcgcaagaataaaactcaaaggaattgacggggacccgcacaagcggtggagcatgtggtttaattcgaagcaacgcgaagaaccttaccaggtcttgacataccgatgacagtcccttaaccgggatcttccttcgggacatcggatacaggtggtgcatggttgtcgtcagctcgtgtcgtgagatgttgggttaagtcccgcaacgagcgcaacccctgttttcagtagccagcatttaggatgggcactctggaaagactgcccgggataaccgggaggaaggcggggatgacgtcaaatcatcatgccccttacgatctgggctacacacgtgctacaatggcggtgacaaagggatgcgaagcagtgatgcttagccaacctcaaaaaagccgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtccgtgacccaaccttttaggagggagcggccgaaggcaggtcggataactggggtgaagtcgtaacaaggtagccgtatcggaaggtgcggctggatcacctcctttctaaggaa

SEQ ID NO: 4600 - DNA, 1553 bp, Lachnospiraceae bacterium AC2031
  ref <308>: DATABASE ACCESSION NUMBER: NCBI ACCESSION: NZ_JIAB01000001.1
  ref <309>: DATABASE ENTRY DATE: 2019-04-01
  ref <313>: RELEVANT RESIDUES IN SEQ ID NO: (1)..(1553)
tttatttgagagtttgatcctggctcaggataaacgctggcggcgtgcttaacacatgcaagtcgaacggagtggttctcccgaggattgatggtgcttgcacctgattgactcatttgaatcacttagtggcggacgggtgagtaacgcgtgggaaacctgccctatactgggggatagcagttggaaacgactgataataccgcataagcgcacaggaccgcatggtccagtgtgaaaaactccggtggtataggatggtcccgcgtctgattagctagttggtgaggtaacggcctaccaaggcgacgatcagtagccggcctgagagggtgtacggccacattgggactgagacacggcccaaactcctacgggaggcagcagtggggaatattggacaatgggggaaaccctgatccagcgacgccgcgtgaacgatgaagtatttcggtatgtaaagttctatcagcagggaagataatgacggtacctgactaagaagcaccggctaaatacgtgccagcagccgcggtaatacgtatggtgcaagcgttatccggatttactgggtgtaaagggtgcgtaggtggcatggtaagtcagatgtgaaaactatgggctcaacccatagactgcatttgaaactgccgagctagagtgcaggagaggaaagtggaattcctagtgtagcggtgaaatgcgtagatattaggaggaacaccagtggcgaaggcggctttctggactgttactgacactgaggcacgaaagcgtggggagcaaacaggattagataccctggtagtccacgccgtaaacgatgaatactaggtgttggggagtaaatcctcggtgccgtcgctaacgcattaagtattccacctggggagtacgttcgcaagaataaaactcaaaggaattgacggggacccgcacaagcggtggagcatgtggtttaattcgaagcaacgcgaagaaccttaccaggtcttgacatcggtatgatcgattcttaaccgaatctttccttcgggacatgctagacaggtggtgcatggttgtcgtcagctcgtgtcgtgagatgttgggttaagtcccgcaacgagcgcaacccctattttcagtagccagcagttcggctgggcactctggagagactgcccgggacaaccgggaggaaggcggggatgacgtcaaatcatcatgccccttacgatctgggctacacacgtgctacaatggcggacacaaagagaagcgaacctgcgagggtgagcaaagctcaaaaattccgtctcagttcggattgtagtctgcaactcgactacatgaagctggaatcgctagtaatcgcgaatcagaacgtcgcggtgaatacgttcccgggtcttgtacacaccgcccgtcacaccatgggagctggaaatgcccaaagtacgtgactcaaccttcgggagagagcgtcctaaggcaggtctggtaactggggtgaagtcgtaacaaggtagccgtatcggaaggtgcggctggatcacctcctttctaaggaa

SEQ ID NO: 4601 - DNA, 886 bp, Lachnospiraceae bacterium AM21-21
  ref <308>: DATABASE ACCESSION NUMBER: NCBI ACCESSION: NZ_QUCN01000099.1
  ref <309>: DATABASE ENTRY DATE: 2019-04-01
  ref <313>: RELEVANT RESIDUES IN SEQ ID NO: (1)..(886)
tgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgac

SEQ ID NO: 4602 - DNA, 1541 bp, Lachnospiraceae bacterium AM23-7LB
  ref <308>: DATABASE ACCESSION NUMBER: NCBI ACCESSION: NZ_QUCF01000027.1
  ref <309>: DATABASE ENTRY DATE: 2019-04-01
  ref <313>: RELEVANT RESIDUES IN SEQ ID NO: (1)..(1541)
gaacatgagagtttgatcctggctcaggatgaacgctggcggcgtgcttaacacatgcaagtcgaacgaaacaccttatttgattttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagtgacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaa

SEQ ID NO: 4603 - DNA, 1541 bp, Lachnospiraceae bacterium AM25-27
  ref <308>: DATABASE ACCESSION NUMBER: NCBI ACCESSION: NZ_QUJY01000007.1
  ref <309>: DATABASE ENTRY DATE: 2019-04-01
  ref <313>: RELEVANT RESIDUES IN SEQ ID NO: (1)..(1541)
gaacatgagagtttgatcctggctcaggatgaacgctggcggcgtgcttaacacatgcaagtcgaacgaaacaccttatttgattttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacttttccttcgggacaggagtgacaggtggtgcatggttgtcgtcagctcgtgtcgtgagatgttgggttaagtcccgcaacgagcgcaacccctatctttagtagccagcatttcaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaa

SEQ ID NO: 4604 - DNA, 1541 bp, Lachnospiraceae bacterium AM26-1LB; identical to SEQ ID NO: 4602
  ref <308>: DATABASE ACCESSION NUMBER: NCBI ACCESSION: NZ_QUJW01000001.1
  ref <309>: DATABASE ENTRY DATE: 2019-04-01
  ref <313>: RELEVANT RESIDUES IN SEQ ID NO: (1)..(1541)

SEQ ID NO: 4605 - DNA, 1421 bp, Lachnospiraceae bacterium AM48-27BH
  ref <308>: DATABASE ACCESSION NUMBER: NCBI ACCESSION: NZ_QUFC01000117.1
  ref <309>: DATABASE ENTRY DATE: 2019-04-01
  ref <313>: RELEVANT RESIDUES IN SEQ ID NO: (1)..(1421)
cctggctcaggatgaacgctggcggcgtgcctaacacatgcaagtcgagcgaagcgatcgagatgaagttttcggatggattcctgattgactgagcggcggacgggtgagtaacgcgtgggtaacctgcctcatacagggggataacagttagaaatgactgctaataccgcataagcgcacagtaccacatggtacggtgtgaaaaactccggtggtatgagatggacccgcgtctgattagctagttggtggggtaacggcccaccaaggcgacgatcagtagccgacctgagagggtgatcggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcagcgcaagtctgaagtgaaagcccggggctcaaccccggaatggctttggaaactgcgcggctagagtaccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgcggtaaacgatgaatgctaggtgttggtgagcaaagctcatcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatcccgatgaaagatccttaaccggattccctcttcggagcatcggagacaggtggtgcatggttgtcgtcagctcgtgtcgtgagatgttgggttaagtcccgcaacgagcgcaacccttatcctcagtagccagcagtaagatgggcactctgtggagactgccagggataacctggaggaaggcggggatgacgtcaaatcatcatgccccttatgatttgggctacacacgtgctacaatggcgtaaacaaagggaagcgagaccgcgaggtggagcaaatcccaaaaataacgtctcagttcggattgcaggctgcaactcgcctgcatgaagctggaatcgctagtaatcgcggatcagaatgccgcggtgaatacgttcccgggtcttgtacacaccgcccgtcacaccatgggagtcgataacgcccgaagtcagtgacctaaccg

SEQ ID NO: 4606 - DNA, 451 bp, Lachnospiraceae bacterium C6A11
  ref <308>: DATABASE ACCESSION NUMBER: NCBI ACCESSION: NZ_JNKY01000003.1
  ref <309>: DATABASE ENTRY DATE: 2019-04-01
  ref <313>: RELEVANT RESIDUES IN SEQ ID NO: (1)..(451)
ttttttatgagagttcgatcctggctcaggatgaacgctggcggcgtgcttaacacatgcaagtcgaacggagtatctctcccgagaccaaagaagcttgcttctgagaaatcaattgagatacttagtggcggacgggtgagtaacgcgtgggtaacctgcctcacacagggggataacagttggaaacgactgttaataccgcataagcgcacggtaccgcatgatacagtgtgaaaaactccggtggtgtgagatggacccgcgtctgattagctagttggtgaggtaacggcccaccaaggcgacgatcagtagccggcctgagagggtaaacggccacattgggactgagacacggcccaaactcctacgggaggcagcagtggggaatattgcacaatgggggaaaccctgatgcagcgacgccgcgtgagcgatgaagtatttc

SEQ ID NO: 4607 - DNA, 1551 bp, Lachnospiraceae bacterium COE1
  ref <308>: DATABASE ACCESSION NUMBER: NCBI ACCESSION: NZ_KE159617.1
  ref <309>: DATABASE ENTRY DATE: 2019-04-01
  ref <313>: RELEVANT RESIDUES IN SEQ ID NO: (1)..(1551)
tttcaatatgagagtttgatcctggctcaggatgaacgctggcggcgtgcttaacacatgcaagtcgaacggacccatattgaaacctggtgatatatgggttagtggcggacgggtgagtaacgcgtgggtaacctgccttacacagggggataacacttggaaataggtgctaaaaccgcataagcgcacagcttcgcatgaagcggtgtgaaaaactccggtggtgtaagatggacccgcgtctgattagcttgttggcggggtaacggcccaccaaggcgacgatcagtagccggcctgagagggcggacggccacattgggactgagacacggcccagactcctacgggaggcagcagtggggaatattgcacaatgggggaaaccctgatgcagcgacgccgcgtgagtgaagaagtaattcgttacgtaaagctctatcagcagggaagaaatactgaccttacggtcagcagacggtacctgagtaagaagccccggctaactacgtgccagcagccgcggtaatacgtagggggcaagcgttatccggatttactgggtgtaaagggagcgtagacggtgcgccaagtctggagtgaaatgccgcagcttaactgcggaactgctttggaaactggcgaactagagtgcgggaggggtaagcggaattcctagtgtagcggtgaaatgcgtagatattaggaggaacaccggtggcgaaggcggcttactggaccgtaactgacgttgaggctcgaaagcgtggggagcaaacaggattagataccctggtagtccacgccgtaaacgatgattactaggtgtcggggacccaagggtctccggtgccgccgcaaacgcattaagtaatccacctggggagtacgttcgcaagaatgaaactcaaaggaattgacggggacccgcacaagcggtggagcatgtggtttaattcgaagcaacgcgaagaaccttacctgcccttgacatccggatgaataaggggtaatgcccttagccctccggggcatccgagacaggtggtgcatggttgtcgtcagctcgtgtcgtgagatgttgggttaagtcccgcaacgagcgcaacccctatcttcagtagccagcattcaggatgggaactcaggagagactgcccgggacaaccgggaggaaggcggggatgacgtcaaatcatcatgccccttatgggcagggctacacacgtgctacaatggcgaaaacagagggaagcgagccggtgacggtaagcaaaccccaaaaacatcgtcccagttcggactgtagtctgcaacccgactacacgaagccggaatcgctagtaatcgcggatcagaatgccgcggtgaatacgttcccgggtcttgtacacaccgcccgtcacaccatgggagtcggaaatgcccgaagtcagtgacctaacctttaagggaggagctgccgaaggtggagccggtaactggggtgaagtcgtaacaaggtagccgtatcggaaggtgcggctggatcacctcctttctagggaa

SEQ ID NO: 4608 - DNA, 1541 bp, Lachnospiraceae bacterium Choco86
  ref <308>: DATABASE ACCESSION NUMBER: NCBI ACCESSION: NZ_AP018535.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcttaacacatgcaagtcgaacgaagcacttgatttgattttcttcggagatgaagatcctgtgactgagtggcggacgggtgagtaacgcgtgggcaacctgccttgtacagggggataacagttagaaatgactgctaataccgcataagaccacagcatcacatgatgcgggggtaaaaactgaggtggtacaagatgggcccgcgtctgattagctggttggtgaggtaacggctcaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaacagcaagtctgatgtgaaaacccggggctcaaccccgggactgcattggaaactgttgatctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgcccttgacatccgaatgaccggtgagtaatgtcgcctttccttcgggacattcgagacaggtggtgcatggttgtcgtcagctcgtgtcgtgagatgttgggttaagtcccgcaacgagcgcaacccttatctttagtagccagcatttaagatgggcactctagagagactgccagggataacctggaggaaggtggggatgacgtcaaatcatcatgccccttatgggcagggctacacacgtgctacaatggcgtaaacaaagggaagcagagtcgtgaggccgagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 4609 - DNA, 1529 bp, Lachnospiraceae bacterium GAM79
  ref <308>: DATABASE ACCESSION NUMBER: NCBI ACCESSION: NZ_AP018536.1
  ref <309>: DATABASE ENTRY DATE: 2019-04-01
  ref <313>: RELEVANT RESIDUES IN SEQ ID NO: (1)..(1529)
tttaacatgagagtttgatcctggctcaggatgaacgctggcggcgtgcctaacacatgcaagtcgaacggacttttcatgaagcctagcgattgaaaagttagtggcggacgggtgagtaacgcgtgggtaacctgccttgtactgggggacaacagttggaaacgactgctaataccgcataagcgcacagcttcgcatgaagcggtgtgaaaaactccggtggtacaagatggacccgcgtctgattagctggttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcaggaaagaaaatgacggtacctgactaagaagccccggctaactacgtgccagcagccgcggtaatacgtagggggcaagcgttatccggatttactgggtgtaaagggagcgtagacggttttgcaagtctgaagtgaaaacccggggcttaaccccgggactgctttggaaactgtagaactagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgctgtaaacgatgattactaggtgttggtgggtacgacccatcggtgccgcagcaaacgcaataagtaatccacctggggagtacgttcgcaagaatgaaactcaaaggaattgacggggacccgcacaagcggtggagcatgtggtttaattcgaagcaacgcgaagaaccttacctggtcttgacatccctatgaataacgggcaatgccgttagtacttcggtacataggagacaggtggtgcatggttgtcgtcagctcgtgtcgtgagatgttgggttaagtcccgcaacgagcgcaacccttatctttagtagccagcagtaagatgggcactctagagagactgccggggataacccggaggaaggtggggatgacgtcaaatcatcatgccccttatgaccagggctacacacgtgctacaatggcgtaaacaaagagaagcgaagtcgtgaggcagagcgaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagtcggtgacctaaccgcaaggaaggagccgccgaaggcaggtctgataactggggtgaagtcgtaacaaggtagccgtatcggaaggtgcggctggatcacctcctttctaaggaa

SEQ ID NO: 4610 - DNA, 1539 bp, Lachnospiraceae bacterium M18-1
  ref <308>: DATABASE ACCESSION NUMBER: NCBI ACCESSION: NZ_KE159605.1
  ref <309>: DATABASE ENTRY DATE: 2019-04-01
  ref <313>: RELEVANT RESIDUES IN SEQ ID NO: (1)..(1539)
taacgagagtttgatcctggctcaggatgaacgctggcggcgtgcttaacacatgcaagtcgagcgaagcacttttttagaactcttcggagggaagagagggtgacttagcggcggacgggtgagtaacgcgtgggcaacctgccttacacagggggataacaattagaaatgattgctaataccgcataagaccacggtactgcatggtacagaggtaaaaactgaggtggtgtaagatgggcccgcgtctgattaggtagttggtggggtagaagcctaccaagccgacgatcagtagccgacctgagagggcgaccggccacattgggactgagacacggcccaaactcctacgggaggcagcagtggggaatattgcacaatgggggaaaccctgatgcagcgacgccgcgtgagtgaggaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggacttgcaagtctgatgtgaaaatccggggcccaaccccggaactgcattggaaactgtatatctagagtgtcggagaggcaagtggaattcctggtgtagcggtgaaatgcgtagatatcaggaggaacaccagtggcgaaggcggcttgctggacgatgactgacgttgaggctcgaaagcgtggggagcaaacaggattagataccctggtagtccacgccgtaaacgatgactactaggtgtcgggaggcaaagcctttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctggccttgacatcccggtgacagcggagtaatgtccgttttccttcgggacactggagacaggtggtgcatggttgtcgtcagctcgtgtcgtgagatgttgggttaagtcccgcaacgagcgcaacccttaccttcagtagccagcatttaggatgggcactctggagggactgccagggacaacctggaggaaggtggggatgacgtcaaatcatcatgccccttatggccagggctacacacgtgctacaatggcgtaaacaaagagaagcgaccacgcgagtgtgagcgaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagccggtgacccaacctaaccaggagggagccgtcgaaggcgggacggatgactggggtgaagtcgtaacaaggtagccgtatcggaaggtgcggctggatcacctcctttctaaggaa

SEQ ID NO: 4611 - DNA, 325 bp, Lachnospiraceae bacterium NK4A179
  ref <308>: DATABASE ACCESSION NUMBER: NCBI ACCESSION: NZ_ATWC01000022.1
  ref <309>: DATABASE ENTRY DATE: 2019-04-01
  ref <313>: RELEVANT RESIDUES IN SEQ ID NO: (1)..(325)
tttatcgagagttcgatcctggctcaggatgaacgctggcggcgtgcttaacacatgcaagtcgaacgggggttagcgagagcttgcttttgctaaaactagtggcggacgggtgagtaacgcgtgagtaacctgccttagactgggggataacacttagaaataggtgctaataccgcataagcgcacagtgccgcatggcacagtgtgaaaaactccggtggtctaagatggactcgcgtctgattagctagttggtgaggtaacggcccaccaaggcgacgatcagtagccggcctgagagggtgaacggccacattgggac

SEQ ID NO: 4612 - DNA, 1291 bp, Lachnospiraceae bacterium OF09-6
  ref <308>: DATABASE ACCESSION NUMBER: NCBI ACCESSION: NZ_QUMM01000077.1
  ref <309>: DATABASE ENTRY DATE: 2019-04-01
  ref <313>: RELEVANT RESIDUES IN SEQ ID NO: (1)..(1291)
ccgcgttggattaggcagttggcggggtaacggcccaccaaaccgacgatccatagccggcctgagagggtgaacggccacattgggactgagacacggcccaaactcctacgggaggcagcagtggggaatattgcacaatgggggaaaccctgatgcagcgacgccgcgtgagtgaagaagtaattcgttatgtaaagctctatcagcagggaagaaaatgacggtacctgactaagaagccccggctaactacgtgccagcagccgcggtaatacgtagggggcaagcgttatccggatttactgggtgtaaagggagcgtagacggccgtgcaagtctgatgtgaaaggctggggctcaaccccgggactgcattggaaactgtatggctggagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgattactaggtgttgggggacatggtccttcggtgccgccgcaaacgcagtaagtaatccacctggggagtacgttcgcaagaatgaaactcaaaggaattgacggggacccgcacaagcggtggagcatgtggtttaattcgaagcaacgcgaagaaccttaccaagtcttgacatcgagaggacagagtatgtaatgtactttcccttcggggcctcaaagacaggtggtgcatggttgtcgtcagctcgtgtcgtgagatgttgggttaagtcccgcaacgagcgcaacccctatcttcagtagccagcaattcggatgggcactctggagagactgccggggataacccggaggaaggcggggatgacgtcaaatcatcatgccccttatgacttgggctacacacgtgctacaatggcgtaaacaaagggaagcgagggagtgatccggagcaaatcccaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagtcgataacgcccgaagtcagtgacccaaccgaaaggagggagctgccgaaggcgggattggtaactggggtgaagtcgtaacaaggtagccgtatcggaaggtgcggctggatcacctcctttctaagga

SEQ ID NO: 4613 - DNA, 1332 bp, Lachnospiraceae bacterium OF11-28
  ref <308>: DATABASE ACCESSION NUMBER: NCBI ACCESSION: NZ_QWGN01000102.1
  ref <309>: DATABASE ENTRY DATE: 2019-04-01
  ref <313>: RELEVANT RESIDUES IN SEQ ID NO: (1)..(1332)
catggtacggtgtgaaaaactccggtggtatgagatggacccgcgtctgattagctagttggtggggtaacggcccaccaaggcgacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgacgcaagtctgaagtgaaatacccgggctcaacctgggaactgctttggaaactgtgttgctagagtgctggagaggtaagcggaattcctagtgtagcggtgaaatgcgtagatattaggaagaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaacactcttaatcgagtgcctccttcgggacagaggtgacaggtggtgcatggttgtcgtcagctcgtgtcgtgagatgttgggttaagtcccgcaacgagcgcaacccctattgtcagtagccagcaggtaaagctgggcactctgatgagactgccagggataacctggaggaaggtggggatgacgtcaaatcatcatgccccttatgatttgggctacacacgtgctacaatggcgtaaacaaagagaagcgagcctgcgagggggagcaaatctcaaaaataacgtctcagttcggattgtagtctgcaactcgactacatgaagctggaatcgctagtaatcgcagacagaatgctgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctcctttctaaggaa

SEQ ID NO: 4614 - DNA, 1541 bp, Lachnospiraceae bacterium OM02-26
  ref <308>: DATABASE ACCESSION NUMBER: NCBI ACCESSION: NZ_QULV01000007.1
  ref <309>: DATABASE ENTRY DATE: 2019-04-01
  ref <313>: RELEVANT RESIDUES IN SEQ ID NO: (1)..(1541)
gaacatgagagtttgatcctggctcaggatgaacgctggcggcgtgcttaacacatgcaagtcgaacgaaacaccttatttgattttcttcggaactgaagatttggtgattgagtggcggacgggtgagtaacgcgtgggtaacctaccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagtgacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaa

SEQ ID NO: 4615 - DNA, 1030 bp, Lachnospiraceae bacterium OM02-3
  ref <308>: DATABASE ACCESSION NUMBER: NCBI ACCESSION: NZ_QVHN01000066.1
  ref <309>: DATABASE ENTRY DATE: 2019-04-01
  ref <313>: RELEVANT RESIDUES IN SEQ ID NO: (1)..(1030)
ttaaacaagagagtttgatcctggctcaggatgaacgctggcggcgtgcctaacacatgcaagtcgaacgaagttagacagaggaagttttcggatggaatcggtataacttagtggcggacgggtgagtaacgcgtgggaaacctgccctgtaccgggggataacacttagaaataggtgctaataccgcataagcgcacggaaccgcatggttgtgtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaaacccagggctcaaccttgggattgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatcccattgacgtgcctgtaaagaggcattcccttcggggcaat

SEQ ID NO: 4616 - DNA, 1537 bp, Lachnospiraceae bacterium OM02-31
  ref <308>: DATABASE ACCESSION NUMBER: NCBI ACCESSION: NZ_QVHM01000099.1
  ref <309>: DATABASE ENTRY DATE: 2019-04-01
  ref <313>: RELEVANT RESIDUES IN SEQ ID NO: (1)..(1537)
ttaaacaagagagtttgatcctggctcaggatgaacgctggcggcgtgcctaacacatgcaagtcgaacgaagttagacagaggaagttttcggatggaatcggtataacttagtggcggacgggtgagtaacgcgtgggaaacctgccctgtaccgggggataacacttagaaataggtgctaataccgcataagcgcacggaaccgcatggttgtgtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaaacccagggctcaaccttgggattgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatccccctgaatatctcgtaaaagggataggccttcgggacaggggagacaggtggtgcatggttgtcgtcagctcgtgtcgtgagatgttgggttaagtcccgcaacgagcgcaacccttattcttagtagccagcaggtaaagctgggcactctaaggagactgccggggataacccggaggaaggcggggatgacgtcaaatcatcatgccccttatgatttgggctacacacgtgctacaatggcgtaaacaaagggaagcgagacagtgatgtggagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagtctgtgacctaaccgaaagggaggagcagccgaaggcaggtctgataactggggtgaagtcgtaacaaggtagccgtatcggaaggtgcggctggatcacctcctttcta

SEQ ID NO: 4617 - DNA, 1551 bp, Lachnospiraceae bacterium OM04-12BH
  ref <308>: DATABASE ACCESSION NUMBER: NCBI ACCESSION: NZ_QULQ01000007.1
  ref <309>: DATABASE ENTRY DATE: 2019-04-01
  ref <313>: RELEVANT RESIDUES IN SEQ ID NO: (1)..(1551)
attaattgagagtttgatcctggctcaggatgaacgctggcggcgtgcctaacacatgcaagtcgaacggagatgcgatgtgagcgagaggtgcttgcactgattaatcttttcgtatcttagtggcggacgggtgagtaacgcgtgggtaacctgccttataccgggggataacacttagaaataggtgctaataccgcataagcgcacggtgtcgcatgacacagtgtgaaaaactccggtggtataagatggacccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaagaaatgacggtacctgactaagaagccccggctaactacgtgccagcagccgcggtaatacgtagggggcaagcgttatccggatttactgggtgtaaagggagcgtagacggtgaagcaagtctgaagtgaaaggttggggctcaaccccgaaactgctttggaaactgtttaactggagtacaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgattactaggtgttggtggatatggatccatcggtgccgcagcaaacgcaataagtaatccacctggggagtacgttcgcaagaatgaaactcaaaggaattgacggggacccgcacaagcggtggagcatgtggtttaattcgaagcaacgcgaagaaccttacctgatcttgacatccctatgaatacagggtaatgcctgtagtacttcggtacataggagacaggtggtgcatggttgtcgtcagctcgtgtcgtgagatgttgggttaagtcccgcaacgagcgcaacccctatctttagtagccagcagtaagatgggcactctagagagactgccggggataacccggaggaaggtggggatgacgtcaaatcatcatgccccttatgaccagggctacacacgtgctacaatggcgtaaacagagggaagcgaagtggtgacatggagcaaatcccaaaaataacgtcccagttcggattgcaggctgcaactcgcctgcatgaagctggaatcgctagtaatcgcagatcagaatgctgcggtgaatacgttcccgggtcttgtacacaccgcccgtcacaccatgggagtaggtaatgcccgaagtcggtgacctaaccgcaaggaaggagccgccgaaggcaggacttataactggggtgaagtcgtaacaaggtagccgtatcggaaggtgcggctggatcacctcctttctaaggaa

SEQ ID NO: 4618 - DNA, 1541 bp, Lachnospiraceae bacterium TF01-11; identical to SEQ ID NO: 556
  ref <308>: DATABASE ACCESSION NUMBER: NCBI ACCESSION: NZ_LLKB01000001.1
  ref <309>: DATABASE ENTRY DATE: 2019-04-01
  ref <313>: RELEVANT RESIDUES IN SEQ ID NO: (1)..(1541)

SEQ ID NO: 4619 - DNA, 1414 bp, Lachnospiraceae bacterium TF10-8AT
  ref <308>: DATABASE ACCESSION NUMBER: NCBI ACCESSION: NZ_QUKL01000066.1
  ref <309>: DATABASE ENTRY DATE: 2019-04-01
  ref <313>: RELEVANT RESIDUES IN SEQ ID NO: (1)..(1414)
gagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactggagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagtgacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaa

SEQ ID NO: 4620 - DNA, 1433 bp, Lachnospiraceae bacterium TWA4
  ref <308>: DATABASE ACCESSION NUMBER: NCBI ACCESSION: NZ_JPZU01000022.1
  ref <309>: DATABASE ENTRY DATE: 2019-04-01
  ref <313>: RELEVANT RESIDUES IN SEQ ID NO: (1)..(1433)
gtctatttgactgagcggcggacgggtgagtaacgcgtgggtaacctaccctatgcagggggataacaactggaaacggttgataataccgcataagcgcacgaaatcgcatgattttgtgtgaaaagccgagacggcataggatggacccgcgtctgattaggcagttggtggggtaacggcctaccaaaccgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaagacggtacctgactaagaagccccggctaactacgtgccagcagccgcggtaatacgtagggggcaagcgttatccggatttactgggtgtaaagggagcgcaggcggcatggcaagccagaagtgaaaacccggggctcaaccccgcggattgcttttggaactgttaagctagagtgcaggaggggcaagcggaattcctagtgtagcggtgaaatgcgtagatattaggaggaacaccggtggcgaaggcggcttgctggactgtaactgacgctgaggctcgaaagcgtggggagcaaacaggattagataccctggtagtccacgccgtaaacgatgaatactaggtgttggcaatcaaagattgtcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgacagactcttaatcgagttttctcttcggacagaggagacaggtggtgcatggttgtcgtcagctcgtgtcgtgagatgttgggttaagtcccgcaacgagcgcaacccttatctttagtagccagtattaagttaggcactctagagagactgccgaggataactcggaggaaggtggggatgacgtcaaatcatcatgccccttatgacttgggctacacacgtgctacaatggcgtaaacaaagagaagcgagaccgtgaggttaagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcggtgacctaaccgcaaggaaggagccgccgaaggtggagccggtgactggggtgaagtcgtaacaaggtagccgtatcggaaggtgcggctggatcacctccttt

SEQ ID NO: 4621 - DNA, 270 bp, Lachnospiraceae bacterium YSB2008
  ref <308>: DATABASE ACCESSION NUMBER: NCBI ACCESSION: NZ_JHWR01000014.1
  ref <309>: DATABASE ENTRY DATE: 2019-04-01
  ref <313>: RELEVANT RESIDUES IN SEQ ID NO: (1)..(270)
tttttttgagagttcgatcctggctcaggataaacgctggcggcgtgcttaacacatgcaagtcgaacggagtattcctcccgagactgacgaaagcttgctttctgaagaatcatttggaatacttagtggcggacgggtgagtaacgcgtgggtaacctgcctcacacagggggataacagttggaaacgactgttaataccgcataagcgcacagtatcgcatggtacagtgtgaaaagctccggcggtgtgagatggacccgcgtc

SEQ ID NO: 4622 - DNA, 1532 bp, Lachnotalea glycerini
  ref <308>: DATABASE ACCESSION NUMBER: NCBI ACCESSION: NZ_QICS01000028.1
  ref <309>: DATABASE ENTRY DATE: 2019-04-01
  ref <313>: RELEVANT RESIDUES IN SEQ ID NO: (1)..(1532)
tttattgagagtttgatcctggctcaggatgaacgctggcggcgtgcttaacacatgcaagtcgaacgaagcattttggagttttcggacaaagaaatgactgagtggcggacgggtgagtaacgcgtgggtaacctgccttatacagggggataacagttagaaatgactgctaataccgcataacccgctagtaccgcatggtacggacggaaaagatttatcggtataagatggacccgcgtctgattagctggttggtgaggtaatggctcaccaaggcaacgatcagtagccggcttgagagagtgaacggccacattgggactgagacacggcccaaactcctacgggaggcagcagtggggaatattgcacaatgggggaaaccctgatgcagcaacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtaggtggcatggcaagtcagatgtgaaaacccagggctcaaccctgggactgcatttgaaactgtcaggctggagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtcggggggcataagctcttcggtgccgcagctaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgacgtagtcgtaatggactatttctttcgggacagaggagacaggtggtgcatggttgtcgtcagctcgtgtcgtgagatgttgggttaagtcccgcaacgagcgcaacccttatctttagtagccagcatgtaagatgggcactctagagagacagccggggataacccggaggaaggcggggatgacgtcaaatcatcatgccccttatgatttgggctacacacgtgctacaatggcgtaaacaaagggaagcgaagtcgtgaggccaagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggaaatgcccgaagtcagtgacccaaccgtaaggagggagctgccgaaggtggagccgataactggggtgaagtcgtaacaaggtagccgtatcggaaggtgcggctggatcacctcctttctaaggaa

SEQ ID NO: 4623 - DNA, 1538 bp, Lacibacter sp. TTM-7
  ref <308>: DATABASE ACCESSION NUMBER: NCBI ACCESSION: NZ_SDHW01000013.1
  ref <309>: DATABASE ENTRY DATE: 2019-04-01
  ref <313>: RELEVANT RESIDUES IN SEQ ID NO: (1)..(1538)
acaatggagagtttgatcctggctcaggatgaacgctagcggcaggcttaatacatgcaagtcgaggggcagcagttttgtagcaatacagaagctggcgaccggcaaacgggtgcggaacacgtacgcaaccttcctttaactgggagatagcccaccgaaaggtggattaatatcccatagtatatttgagtggcatcacttagatattaaagctccggcggttaaagatgggcgtgcgtctgattaggtagttggcggggtaacggcccaccaagcctacgatcagtagctgatgtgagagcatgatcagccacacgggcactgagacacgggcccgactcctacgggaggcagcagtaaggaatattggtcaatggacgcaagtctgaaccagccatgccgcgtggaggatgaaggtcctctggattgtaaacttcttttctttgggacgaaacccctgtttctacggggactgacggtaccagaggaataagcaccggctaactccgtgccagcagccgcggtaatacggagggtgcaagcgttatccggattcactgggtttaaagggagcgtaggtgggcttttaagtcagtggtgaaatctttgggcttaacccgaaaactgccattgatactattagtcttgaattctctggaggtaagcggaatatgtcatgtagcggtgaaatgcttagatatgacatagaacacccattgcgaaggcagcttactacggagcgattgacactgaggctcgaaagcgtggggatcaaacaggattagataccctggtagtccacgccctaaacgatgattactcgacattagcgatattactgttagtgtctaagcgaaagcattaagtaatccacctgggaagtacgaccgcaaggttgaaactcaaaggaattggcgggggtccgcacaagtggtggagcatgtggtttaattcgatgatacgcgaggaaccttacctgggctagaatgtcacttgaccgatggtgaaagccatttttctagcaatagacaggtgataaggtgctgcatggctgtcgtcagctcgtgccgtgaggtgttgggttaagtcccgcaacgagcgcaacccctatctttagttgccatcaggtaatgctgggaactctaaagaaactgccgtcgtaagacgtgaggaaggaggggatgatgtcaagtcatcatggcctttatgcccagggctacacacgtgctacaatgggggggacaaagggctgccacttagcgataaggagctaatcccaaaaaccctctctcagttcagattggagtctgcaactcgactccatgaagctggaatcactagtaatcgtatatcagcaatgatacggtgaatacgttcccggaccttgcacacaccgcccgtcaagccatggaagctgggtgtacctaaagtcggtaaccgcaaggagccgcctagggtaaaactagtgactggggctaagtcgtaacaaggtagccgtaccggaaggtgcggctggaatacctcctttttagagc

SEQ ID NO: 4624 - DNA, 217 bp, Lacticigenium naphtae
  ref <308>: DATABASE ACCESSION NUMBER: NCBI ACCESSION: NZ_AUEG01000014.1
  ref <309>: DATABASE ENTRY DATE: 2019-04-01
  ref <313>: RELEVANT RESIDUES IN SEQ ID NO: (1)..(217)
tttaacgagagtttgatcctggctcaggacgaacgctggcggcatgcctaatacatgcaagtcgaacgctgaagctctctgcttgcagagagtggaagagtggcgaacgggtgagtaacacgtggggaacctgcccatgagagggggataacatccggaaacggatgctaataccgcataactaaagaaaccgcatggtttttttataaaagatggc

SEQ ID NO: 4625 - DNA, 1575 bp, Lactobacillus acidifarinae
  ref <308>: DATABASE ACCESSION NUMBER: NCBI ACCESSION: NZ_AZDV01000008.1
  ref <309>: DATABASE ENTRY DATE: 2019-04-01
  ref <313>: RELEVANT RESIDUES IN SEQ ID NO: (1)..(1575)
ttaagatgagagtttgatcctggctcaggacgaacgctggcggcatgcctaatacatgcaagtcgaacgagttcccgttgattgacgtgcttgcactgatttcaacattggaacgagtggcgaactggtgagtaacacgtggaaaacctgcccagaagcaggggataacacttggaaacaggtgctaataccgtataacaacaaaaaccgcatggtttttgtttgaaaggtggcttcggctatcacttctggatggttccgcggcgcattagctagttggtgaggtaaaggcccaccaaggcaatgatgcgtagccgacctgagagggtaatcggccacattgggactgagacacggcccagactcctacgggaggcagcagtagggaatcttccacaatggacgaaagtctgatggagcaatgccgcgtgagtgaagaagggtttcggctcgtaaaactctgttgttgaagaagaacgggtgtcagagtaactgttgacatcgtgacggtattcaaccagaaagccacggctaactacgtgccagcagccgcggtaatacgtaggtggcaagcgttgtccggatttattgggcgtaaagcgagcgcaggcggttatttaagtctgatgtgaaagccttcggcttaaccgaagaagtgcatcggaaactgggtgacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatcttagagataagacgttcccttcggggacagaatgacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggacggtacaacgagtcgcgaagtcgtgaggccaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtggggtaaccttcgggagccagccgtctaaggtgggacagatgattagggtgaagtcgtaacaaggtagccgtaggagaacctgcggctggatcacctcctttctaaggaa

SEQ ID NO: 4626 - DNA, 1575 bp, Lactobacillus acidipiscis
  ref <308>: DATABASE ACCESSION NUMBER: NCBI ACCESSION: NZ_LT630287.1
  ref <309>: DATABASE ENTRY DATE: 2019-04-01
  ref <313>: RELEVANT RESIDUES IN SEQ ID NO: (1)..(1575)
tttaaaatgagagtttgatcctggctcaggacgaacgctggcggcgtgcctaatacatgcaagtcgaacgcaatctttgactaatgagtgcttgcactcagcggtcaaagtgcgagtggcgaacgggtgagtaacacgtgggcaatctgcccaaaagtgggggataacacttggaaacaggtgctaataccgcatcaaccggctgaccgcatggtcggccgggcaaagacggcgtcagctgtcgcttttggatgagcccgcggcgtattaactagttggtaaggtaacggcttaccaaggtgatgatacgtagccgaactgagaggttgatcggccacattgggactgagacacggcccaaactcctacgggaggcagcagtagggaatcttccacaatggacgcaagtctgatggagcaacgccgcgtgtatgaagaaggtcttcggatcgtaaaatactgttgtcagagaagaacacgtgatagagtaactgctatgacgctgacggtatctgaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagaagtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcgtggggagcgaacaggattagataccctggtagtccacgctgtaaacgatgaatgctaggtgttggagggtttccgcccttcggtgccgcagctaacgcactaagcattccgcctggggagtacgatcgcaagattgaaactcaaaggaattgacgggggcccgcacaagcggtggagcatgtggtttaattcgaagcaacgcgaagaaccttaccaggtcttgacatcttttgaccatctgagagatcagaaattcccttcggggacaaaatgacaggtggtgcatggctgtcgtcagctcgtgtcgtgagatgttgggttaagtcccgcaacgagcgcaacccttattgtcagttgccagcattcagttgggcactctggcgagactgccggtgacaaaccggaggaaggtggggatgacgtcaagtcatcatgccccttatgacctgggctacacacgtgctacaatggacgatacaacgagtcgcgagaccgcgaggtttagctaatctctgaaagtcgttctcagttcggatcgtaggctgcaactcgcctacgtgaagtcggaatcgctagtaatcgcggatcagcatgccgcggtgaatacgttcccgggccttgtacacaccgcccgtcacaccatgagagtttgtaacacccaaagccggtgcggtaaccattttggagccagccgtctaaggtgggacagatgattggggtgaagtcgtaacaaggtagccgtaggagaacctgcggctggatcacctcctttctaaggaa

SEQ ID NO: 4627 - DNA, 1581 bp, Lactobacillus acidophilus
  ref <308>: DATABASE ACCESSION NUMBER: NCBI ACCESSION: NZ_LR134325.1
  ref <309>: DATABASE ENTRY DATE: 2019-04-01
  ref <313>: RELEVANT RESIDUES IN SEQ ID NO: (1)..(1581)
gaaaatgagagtttgatcctggctcaggacgaacgctggcggcgtgcctaatacatgcaagtcgagcgagcttgcctagatgaatttggtgcttgcaccaaatgaaactagatacaagcgagcggcggacgggtgagtaacacgtgggtaacctgcccaagagactgggataacacctggaaacagatgctaataccggataacaacactagacgcatgtctagagtttaaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggagttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctctgaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctcctttctaaggaa

SEQ ID NO: 4628 - DNA, 1572 bp, Lactobacillus agilis
  ref <308>: DATABASE ACCESSION NUMBER: NCBI ACCESSION: NZ_PKGM01000053.1
  ref <309>: DATABASE ENTRY DATE: 2019-04-01
  ref <313>: RELEVANT RESIDUES IN SEQ ID NO: (1)..(1572)
ctaaaatgagagtttgatcctggctcaggacgaacgctggcggcgtgcctaatacatgcaagtcgaacgcttttttcaatcatcgtagcttgctacaccgattggaaattgagtggcgaacgggtgagtaacacgtgggtaacctgcccaaaagagggggataacacttggaaacaggtgctaataccgcataaccatgatgaccgcatggtcattatgtaaaagatggtttcggctatcacttttggatggacccgcggcgtattaacttgttggtggggtaacggcctaccaaggtaatgatacgtagccgaactgagaggttgatcggccacattgggactgagacacggcccaaactcctacgggaggcagcagtagggaatcttccacaatgggcgcaagcctgatggagcaacgccgcgtgagtgaagaaggtcttcggatcgtaaaactctgttgttagagaagaacatgcaggagagtaactgttcttgtattgacggtatctaaccagaaagccacggctaactacgtgccagcagccgcggtaatacgtaggtggcaagcgttgtccggatttattgggcgtaaagggaacgcaggcggtcctttaagtctgatgtgaaagccttcggcttaaccgaagaattgcattggaaactggaggacttgagtgcagaagaggagagtggaactccatgtgtagcggtgaaatgcgtagatatatggaagaacaccagtggcgaaagcggctctctggtctgtaactgacgctgaggttcgaaagtgtgggtagcaaacaggattagataccctggtagtccacaccgtaaacgatgaatgctaagtgttggagggtttccgcccttcagtgctgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcttttgaccatcttagagataagattttcccttcggggacaaaatgacaggtggtgcatggctgtcgtcagctcgtgtcgtgagatgttgggttaagtcccgcaacgagcgcaacccttgttgtcagttgccagcattaagttgggcactctggcgagactgccggtgacaaaccggaggaaggtggggacgacgtcaagtcatcatgccccttatgacctgggctacacacgtgctacaatggacggtacaacgagtcgcaaactcgcgagggcaagctaatctcttaaagccgttctcagttcggattgtaggctgcaactcgcctacatgaagtcggaatcgctagtaatcgcgaatcagcatgtcgcggtgaatacgttcccgggccttgtacacaccgcccgtcacaccatgagagtttgtaacacccaaagccggtggggtaaccttttaggagctagccgtctaaggtgggacagatgattggggtgaagtcgtaacaaggtagccgtaggagaacctgcggctggatcacctcctttctaaggaa

SEQ ID NO: 4629 - DNA, 1570 bp, Lactobacillus algidus
  ref <308>: DATABASE ACCESSION NUMBER: NCBI ACCESSION: NZ_OBKY01000013.1
  ref <309>: DATABASE ENTRY DATE: 2019-04-01
  ref <313>: RELEVANT RESIDUES IN SEQ ID NO: (1)..(1570)
ttatatgagagtttgatcctggctcaggatgaacgctggcggcgtgcctaatacatgcaagtcgaacgcattgttcttcaccgagtgcttgcactcaccgaagacaatgagtggcgaacgggtgagtaacacgtgggtaacctgcccaaaagagggggataacacttggaaacaggtgctaataccgcataatttgtcaaaccgcatggtttgataatgaaagacggcgtaagctgtcacttttggatggacccgcggcgtattagctagttggtgaggtaaaggcccaccaaggcaatgatacgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaagctctgttgttagagaagaatgtaggtaagagtaactgtttacctagtgacggtatctaaccagaaagccacggctaactacgtgccagcagccgcggtaatacgtaggtggcaagcgttatccggatttattgggcgtaaagcgaacgcaggcggttttttaagtctgatgtgaaagccttcggctcaaccgaagaaatgcattggaaactggataacttgagtgcagaagaggagagtggaacaccatgtgtagcggtgaaatgcgtagatatatggtagaacaccagtggcgaaagcggctctctggtctgtaactgacgctgaggttcgaaagcatgggtagcaaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcttctgacaaacctagagataggccgttcccttcggggacagaatgacaggtggtgcatggttgtcgtcagctcgtgtcgtgagatgttgggttaagtcccgcaacgagcgcaacccttattattagttgccagcatttagttgggcactctaatgagactgccggtgacaaaccggaggaaggtggggatgacgtcaaatcatcatgccccttatgacctgggctacacacgtgctacaatggacggtacaacgagttgcgagaccgcgaggttaagctaatctcttaaagccgttctcagttcggattgtaggctgcaactcgcctacatgaagttggaatcgctagtaatcgcggatcagaatgccgcggtgaatacgttcccgggccttgtacacaccgcccgtcacaccatgagagtttgtaacacccaaagccggtgaggtaaccttttaggagccagccgtctaaggtgggacagatgattagggtgaagtcgtaacaaggtagccgtaggagaacctgcggctggatcacctcctttctaaggaa

SEQ ID NO: 4630 - DNA, 1575 bp, Lactobacillus alimentarius
  ref <308>: DATABASE ACCESSION NUMBER: NCBI ACCESSION: NZ_CP018867.1
  ref <309>: DATABASE ENTRY DATE: 2019-04-01
  ref <313>: RELEVANT RESIDUES IN SEQ ID NO: (1)..(1575)
ttaatatgagagtttgatcctggctcaggacgaacgctggcggcatgcctaatacatgcaagtcgaacgaactttcctattgattgatgcttgcatcatgatttagatctaagtgagtggcggacgggtgagtaacacgtgggtaacctgcccagaagtgggggataacatttggaaacaagtgctaataccgcataacaacattaaacacatgttttttgtttaaaagatggttttgctatctcttctggatggacccgcggcgtattagctagttggtgaggtaatagctcaccaaggcgatgatacgtagccgacctgagagggtaatcggccacattgggactgagacacggcccaaactcctacgggaggcagcagtagggaatcttccacaatggacgaaagtctgatggagcaatgccgcgtgagtgaagaaggttttcggatcgtaaaactctgttgttgaagaagaacatatgtgagagtaactgttcacgtactgacggtattcaaccagaaagccacggctaactacgtgccagcagccgcggtaatacgtaggtggcaagcgttgtccggatttattgggcgtaaagagaatgtaggcagttcattaagtttgaagtgaaagccctcggctcaaccgaggaagtgcttcgaaaactggtgaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgataaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgcaggctgcaactcgcctgcatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgcggctggatcacctcctttctaagga

SEQ ID NO: 4631 - DNA, 1585 bp, Lactobacillus allii
  ref <308>: DATABASE ACCESSION NUMBER: NCBI ACCESSION: NZ_RHNV01000015.1
  ref <309>: DATABASE ENTRY DATE: 2019-04-01
  ref <313>: RELEVANT RESIDUES IN SEQ ID NO: (1)..(1585)
ttaatatgagagtttgatcctggctcaggacgaacgctggcggcgtgcctaatacatgcaagtcgagcgaactctggtttttgatttttggtgcttgcaccaaaatgataaaacatttgagtgagcggcggatgggtgagtaacacgtgggtaacctgccctaaagtgggggataacatttggaaacaagtgctaataccgcataacaacatttaccacatggtttatgtttaaaagatggttttgctatcactttaggatggacccgcggcgtattagttagttggtgaggtaatggctcaccaagaccgtgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcacgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggagagtggaactccatgtgtagcggtggaatgcgtagatatatggaagaacaccagtggcgaaggcggctctctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttattaggagctaaccgtctaaggtgggacaaatgattagggtgaagtcgtaacaaggtagccgtaggagaacctgcggctggatcacctcctttctaagga

SEQ ID NO: 4632 - DNA, 1572 bp, Lactobacillus amylolyticus
  ref <308>: DATABASE ACCESSION NUMBER: NCBI ACCESSION: NZ_CP031835.1
  ref <309>: DATABASE ENTRY DATE: 2019-04-01
  ref <313>: RELEVANT RESIDUES IN SEQ ID NO: (1)..(1572)
aaaaatgagagtttgatcctggctcaggacgaacgctggcggcgtgcctaatacatgcaagtcgagcgagcagaactaacagatctacttcggtagtgacgtttcggaagcgagcggcggatgggtgagtaacacgtgggtaacctgcccttaagtctgggataccacttggaaacaggtgctaataccggataacaacaagtgctgcatggcacttgcttgaaaggcggcgcaagctgtcgctaaaggatggacccgcggtgcattagctagttggtaaggtaacggcttaccaaggcaacgatgcatagccgagttgagagactgatcggccacattgggactgagacacggcccaaactcctacgggaggcagcagtagggaatcttccacaatgggcgaaagcctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggagaaataagtctgatgtgaaagccctcggcttaaccggggaattgcatcggaaactgtttttcttgagtgcagaagaggagagtggaactccatgtgtagcggtggaatgcgtagatatatggaggaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgcaatccgtagagatacggagttcccttcggggacgctaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggacgacgtcaagtcatcatgccccttatgacctgggctacacacgtgctacaatgggcagtacaacgagaagcaagcctgcgaaggcaagcgaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccgaagccggtggcctaaccttcgggaaggagccgtctaaggcagggcagatgactggggtgaagtcgtaacaaggtagccgtaggagaacctgcggctggatcacctcctttctaaggaa

SEQ ID NO: 4633 - DNA, 1586 bp, Lactobacillus amylophilus
  ref <308>: DATABASE ACCESSION NUMBER: NCBI ACCESSION: NZ_CP018888.1
  ref <309>: DATABASE ENTRY DATE: 2019-04-01
  ref <313>: RELEVANT RESIDUES IN SEQ ID NO: (1)..(1586)
aagtaaaattgagagtttgatcctggctcaggatgaacgctggcggcgtgcctaatacatgcaagtcgaacgagttctggttaagagtagcggtgcttgcaccaaagcaattaacaatggaacgagtggcggacgggtgagtaacacgtgggtaacctaccctatagcgggggataacatttggaaacagatgctaataccgcataacaacaactatcacatgatagatgtttgaaagatggcgaaagctatcactaaaggatggacctgcggcgtattagttagttggtaaggtaacggcttaccaagacgatgatacgtagccgacttgagagagtgatcggccacattgggactgagacacggcccaaactcctacgggaggcagcagtagggaatcttccacaatggacgaaagtctgatggagcaacgccgcgtgagtgaagaagggtttcggctcgtaaaactctgttattggagaagaaggataaggtaagtaactgtactttatttgacggtaaccaaccagaaagtcacggctaactacgtgccagcagccgcggtaatacgtaggtggcaagcgttatccggaattattgggcgtaaagcgagtgcaggcggttgtataagtctgatgtgaaagccctcggctcaaccgaggaattgcatcagaaactgtataacttgagtgcagaagaggagagtggaactccatgtgtagcggtggaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcccagagatgggacgtttccttcgggaacgctaagacaggtggtgcatggttgtcgtcagctcgtgtcgtgagatgttgggttaagtcccgcaacgagcgcaacccttattactagttgccagcattaagatgggcactctagtgagactgccggtgacaaaccggaggaaggtggggatgacgtcaaatcatcatgccccttatgacctgggctacacacgtgctacaatgggcggtacaacgagttgctaacttgtgaaagtaagcgaatctctaaaaaccgttctcagttcggattgtaggctgcaactcgcctacatgaagctggaatcgctagtaatcgtggatcagcatgccacggtgaatacgttcccgggccttgtacacaccgcccgtcacaccatgagagtttgtaacacccaaagccggtgaggtaaccattaatggagccagccgtctaaggtgggatagatgattagggtgaagtcgtaacaaggtagccgtaggagaacctgcggctggatcacctcctttctaaggaa

SEQ ID NO: 4634 - DNA, 1582 bp, Lactobacillus amylotrophicus
  ref <308>: DATABASE ACCESSION NUMBER: NCBI ACCESSION: NZ_AZCV01000017.1
  ref <309>: DATABASE ENTRY DATE: 2019-04-01
  ref <313>: RELEVANT RESIDUES IN SEQ ID NO: (1)..(1582)
aaaattgagagtttgatcctggctcaggatgaacgctggcggcgtgcctaatacatgcaagtcgaacgagttctggttaagagtagcggtgcttgcaccaaagcgattaacaatggaacgagtggcggacgggtgagtaacacgtgggtaacctaccctatagcgggggataacatttggaaacagatgctaataccgcataacaacaactatcacatgatagatgtttgaaagatggcgaaagctatcactaaaggatggacctgcggcgtattagttagttggtaaggtaacggcttaccaagacgatgatacgtagccgacttgagagagtgatcggccacattgggactgagacacggcccaaactcctacgggaggcagcagtagggaatcttccacaatggacgaaagtctgatggagcaacgccgcgtgagtgaagaagggtttcggctcgtaaaactctgttattggagaagaaggataaggtaagtaactgtactttatttgacggtaaccaaccagaaagtcacggctaactacgtgccagcagccgcggtaatacgtaggtggcaagcgttatccggaattattgggcgtaaagcgagtgcaggcggttgtataagtctgatgtgaaagccctcggctcaaccgaggaattgcatcagaaactgtataacttgagtgcagaagaggagagtggaactccatgtgtagcggtggaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcccagagatgggacgtttccttcgggaacgctaagacaggtggtgcatggttgtcgtcagctcgtgtcgtgagatgttgggttaagtcccgcaacgagcgcaacccttattactagttgccagcattaagatgggcactctagtgagactgccggtgacaaaccggaggaaggtggggatgacgtcaaatcatcatgccccttatgacctgggctacacacgtgctacaatgggcggtacaacgagttgcgaacttgtgaaagtaagcgaatctctaaaaaccgttctcagttcggattgtaggctgcaactcgcctacatgaagctggaatcgctagtaatcgtggatcagcatgccacggtgaatacgttcccgggccttgtacacaccgcccgtcacaccatgagagtttgtaacacccaaagccggtgaggtaaccattaatggagccagccgtctaaggtgggatagatgattagggtgaagtcgtaacaaggtagccgtaggagaacctgcggctggatcacctcctttctaaggaa

SEQ ID NO: 4635 - DNA, 1573 bp, Lactobacillus amylovorus
  ref <308>: DATABASE ACCESSION NUMBER: NCBI ACCESSION: NZ_QSAX01000026.1
  ref <309>: DATABASE ENTRY DATE: 2019-04-01
  ref <313>: RELEVANT RESIDUES IN SEQ ID NO: (1)..(1573)
ttaaaatgagagtttgatcctggctcaggacgaacgctggcggcgtgcctaatacatgcaagtcgagcgagcggaaccaacagatttacttcggtaatgacgttgggaaagcgagcggcggatgggtgagtaacacgtggggaacctgcccctaagtctgggataccatttggaaacaggtgctaataccggataataaagcagatcgcatgatcagcttttgaaaggcggcgtaagctgtcgctaagggatggccccgcggtgcattagctagttggtaaggtaacggcttaccaaggcgacgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaaaaataagtctaatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgcaatctgtagagatacggagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcaagcctgcgaaggcaagcgaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagccgtctaaggcagggcagatgactggggtgaagtcgtaacaaggtagccgtaggagaacctgcggctggatcacctcctttctaaggaa

SEQ ID NO: 4636 - DNA, 1571 bp, Lactobacillus animalis
  ref <308>: DATABASE ACCESSION NUMBER: NCBI ACCESSION: NZ_POVP01000013.1
  ref <309>: DATABASE ENTRY DATE: 2019-04-01
  ref <313>: RELEVANT RESIDUES IN SEQ ID NO: (1)..(1571)
taaattgagagtttgatcctggctcaggatgaacgctggcggcgtgcctaatacatgcaagtcgaacgaaacttctttatcaccgagtgcttgcactcaccgataaagagttgagtggcgaacgggtgagtaacacgtgggcaacctgcccaaaagagggggataacacttggaaacaggtgctaataccgcataaccatagttaccgcatggtaactatgtaaaaggtggctatgctaccgcttttggatgggcccgcggcgcattagctagttggtgaggtaaaggcttaccaaggcaatgatgcgtagccgaactgagaggttgatcggccacattgggactgagacacggcccaaactcctacgggaggcagcagtagggaatcttccacaatgggcgaaagcctgatggagcaacgccgcgtgggtgaagaaggtcttcggatcgtaaaaccctgttgttagagaagaaagtgcgtgagagtaactgttcacgtttcgacggtatctaaccagaaagccacggctaactacgtgccagcagccgcggtaatacgtaggtggcaagcgttatccggatttattgggcgtaaagggaacgcaggcggtcttttaagtctgatgtgaaagccttcggcttaaccggagtagtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaagtgttggagggtttccgcccttcagtgctgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcttctgacaatcctagagataggactttcccttcggggacagaatgacaggtggtgcatggttgtcgtcagctcgtgtcgtgagatgttgggttaagtcccgcaacgagcgcaacccttattgttagttgccagcattaagttgggcactctagcaagactgccggtgacaaaccggaggaaggtggggatgacgtcaaatcatcatgccccttatgacctgggctacacacgtgctacaatggacggtacaacgagtcgcaagaccgcgaggtttagcaaatctcttaaagccgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtggggtaaccttttggagccagccgtctaaggtgggacagatgattggggtgaagtcgtaacaaggtagccgtaggagaacctgcggctggatcacctcctttctaagga

SEQ ID NO: 4637 - DNA, 1585 bp, Lactobacillus antri
  ref <308>: DATABASE ACCESSION NUMBER: NCBI ACCESSION: NZ_AZDK01000028.1
  ref <309>: DATABASE ENTRY DATE: 2019-04-01
  ref <313>: RELEVANT RESIDUES IN SEQ ID NO: (1)..(1585)
tttatatgagagtttgatcctggctcaggatgaacgccggcggtgtgcctaatacatgcaagtcgagcgcactggcccaactgaaatgacgtgcttgcacagaatggacgttggattcccagtgagcggcggacgggtgagtaacacgtgggcaacctgccccaaagcgggggataacatttggaaacagatgctaataccgcataagttggaaaaccacatggttttcccatcaaagatggtttcggctatcgctttgggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtaagagtaactgtttacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccgaagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaacctcagagatgaggcgttcccttcggggacgcaaagacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggccggtacaacgagcagctaacccgcgagggtgtgcaaatctcttaaagccggtctcagttcggactgcagtctgcaactcgactgcacgaagtcggaatcgctagtaatcgcggatcagcatgccgcggtgaatacgttcccgggccttgtacacaccgcccgtcacaccatggaagtttgcaatgcccaaagtcagtggcctaaccattatggagggagctgcctaaggcagggcagatgactggggtgaagtcgtaacaaggtagccgtaggagaacctgcggctggatcacctcctttctaaggaa

SEQ ID NO: 4638 - DNA, 1574 bp, Lactobacillus apis
  ref <308>: DATABASE ACCESSION NUMBER: NCBI ACCESSION: NZ_FMAN01000012.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaaagttaaaggaatacttcggtaggaatttaatagcgcgagcggcggatgggtgagtaacacgtgggcaacctgccctttagcttgggataccacttggaaacaggtgctaataccaaataagaagtaagagcgcatgctcaagctatgaaaggcggctttcgagctgtcactaaaggatgggcccgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacatgggtagtaactgatctatgtttgacggtaatcaaccagaaagtcacggctaactacgtgccagcagccgcggtaatacgtaggtggcaagcgttgtccggatttattgggcgtaaagcgaacgcaggcgggagaacaagtcagctgtgaaagccctcggcttaaccgaggaacggcaactgaaactgtttttcttgagtgcagaagaggagagtggaactccatgtgtagcggtgaaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgccaaccctagagatagggtgtttccttcgggaacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgaggagcgaacctgtgaaggcaagcgaatctcttaaagctaatctcagttcggattgcactctgcaactcgagtgcatgaagctggaatcgctagtaatcgcggatcagcatgccgcggtgaatacgttcccgggccttgtacacaccgcccgtcacaccatgagagtttgtaatacccaaagccggtgagataacctgtaaaggagtcagccgtctaaggtaggacagatgattagggtgaagtcgtaacaaggtagccgtaggagaacctgcggctggatcacctcctttctaaggaa

SEQ ID NO: 4639 - DNA, 1512 bp, Lactobacillus apodemi
  ref <308>: DATABASE ACCESSION NUMBER: NCBI ACCESSION: NZ_AZFT01000005.1
  ref <309>: DATABASE ENTRY DATE: 2019-04-01
  ref <313>: RELEVANT RESIDUES IN SEQ ID NO: (1)..(1512)
ttaaattgagagtttgatcctggctcaggatgaacgctggcggcgtgcctaatacatgcaagtcgaacgaagcttctttatcaccgagtgcttgcactcaccgataaagagcttagtggcgaacgggtgagtaacacgtgggcaacctgcccaaaagagggggataacacttggaaacaggtgctaataccgcataaccacagttaccgcatggtaactgtgtaaaaggtggctatgctaccgcttttggatgggcccgcggcgcattagctagttggtgaggtaaaggcttaccaaggcaatgatgcgtagccgaactgagaggttgatcggccacattgggactgagacacggcccaaactcctacgggaggcagcagtagggaatcttccacaatgggcgaaagcctgatggagcaacgccgcgtgggtgaagaaggtcttcggatcgtaaaaccctgttgttagagaagaaagtgcgtgagagtaactgttcacgtttcgacggtatctaaccagaaagccacggctaactacgtgccagcagccgcggtaatacgtaggtggcaagcgttatccggatttattgggcgtaaagggaacgcaggcggtcttttaagtctgatgtgaaagccttcggcttaaccggagtagtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaagtgttggagggtttccgcccttcagtgctgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcttctgacaatcctagagataggacttctccttcgggagcagaatgacaggtggtgcatggttgtcgtcagctcgtgtcgtgagatgttgggttaagtcccgcaacgagcgcaacccttgttgttagttgccagcattaagttgggcactctagcaagactgccggtgacaaaccggaggaaggtggggatgacgtcaaatcatcatgccccttatgacctgggctacacacgtgctacaatggacggtacaacgagtcgcgagaccgcgaggtttagcaaatctcttaaagccgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtggggtaaccttttggagccagccgtctaaggtgggacagatgattgggg

SEQ ID NO: 4640 - DNA, 1566 bp, Lactobacillus aquaticus
  ref <308>: DATABASE ACCESSION NUMBER: NCBI ACCESSION: NZ_AYZD01000026.1
  ref <309>: DATABASE ENTRY DATE: 2019-04-01
  ref <313>: RELEVANT RESIDUES IN SEQ ID NO: (1)..(1566)
taaaatgagagtttgatcctggctcaggacgaacgctggcggcgtgcctaatacatgcaagtcgtacgcaaaactttcaccgagtgcttgcactcaccgaaagttttgagtggcgaacgggtgagtaacacgtgggtaacctgcccagaagaaggggataacacttggaaacaggtgctaataccgtataacaacaaagaccgcatggtctttgtttaaaagatggttctgctatcacttctggatggacccgcggcgtattagctagttggtgaggtaatggctcaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtgtgtgagagtaactgttcatgcagtgacggtatctaaccagaaagccacggctaactacgtgccagcagccgcggtaatacgtaggtggcaagcgttgtccggatttattgggcgtaaagggaacgcaggcggttttttaagtctgatgtgaaagccttcggcttaaccgaagtcatgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcatgggtagcaaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttctgccaatctgagagatcagatgttcccttcggggacagaatgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgacctgggctacacacgtgctacaatggacagtacaacgagtcgcaagaccgcgaggtcaagctaatctcttaaagctgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtgaggtaaccttttggagccagccgtctaaggtgggacagatgattggggtgaagtcgtaacaaggtagccgtaggagaacctgcggctggatcacctcctttctaagga

SEQ ID NO: 4641 - DNA, 1576 bp, Lactobacillus aviarius
  ref <308>: DATABASE ACCESSION NUMBER: NCBI ACCESSION: NZ_PCZQ01000048.1
  ref <309>: DATABASE ENTRY DATE: 2019-04-01
  ref <313>: RELEVANT RESIDUES IN SEQ ID NO: (1)..(1576)
gaagagaaattgagaggttgatccgggagcaggacgaacgctggcggcgtgctgaattgctgcaagtcgaacgagaatttcttacaccgagtgcttgcactcaccgtaagaaattcgagtggcggacgggtgagtaacacgtgggtaacctgcccaaaagaaggggataacatttggaaacaaatgctaataccgtataaccatgatgaccgcatggtcattatgtaaaaggtggttttgctatcgcttttggatggacccgcggcgtattaactagttggtagggtaacggcctaccaaggtgatgatacgtagccgagttgagagactgatcggccacaatgggactgagacacggcccatactcctacgggaggcagcagtagggaatcttccacaatgggcgcaagcctgatggagcaacgccgcgtgaatgaagaaggtcttcggatcgtaaaattctgttgttagagaagaatatgagtaatagtaactgattattcactgacggtatctaaccagcaagtcacggctaactacgtgccagcagccgcggtaatacgtaggtggcaagcgttgtccggatttattgggcgtaaagggaacgcaggcggttttttaagtctgatgtgaaagccttcggcttaaccggagatgtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcatgggtagcgaacaggattagataccctggtagtccatgccgtaaacgatgaatgctaggtgttggagggtttccgcccttcagtgccgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcttttgaccacctaagagattaggttttcccttcggggacaaaatgacaggtggtgcatggctgtcgtcagctcgtgtcgtgagatgttgggttaagtcccgcaacgagcgcaacccttgttgtcagttgccatcatttagttgggcactctggcgagactgccggtgacaaaccggaggaaggtggggatgacgtcaagtcatcatgccccttatgacctgggctacacacgtgctacaatggacgatacaacgagtcgcgagaccgcgaggttaagctaatctcttaaagtcgttctcagttcggattgcaggctgcaactcgcctgcatgaagtcggaatcgctagtaatcgcggatcagcatgccgcggtgaatacgttcccgggccttgtacacaccgcccgtcacaccatgagagtttgtaacacccaaagccggtggagtaaccatttggagctagccgtctaaggtgggacagatgattggggtgaagtcgtaacaaggtagccgtaggagaacctgcggctggatcacctcctttctaaggaa

SEQ ID NO: 4642 - DNA, 1577 bp, Lactobacillus backii
  ref <308>: DATABASE ACCESSION NUMBER: NCBI ACCESSION: NZ_RHNQ01000007.1
  ref <309>: DATABASE ENTRY DATE: 2019-04-01
  ref <313>: RELEVANT RESIDUES IN SEQ ID NO: (1)..(1577)
ttatatgagagtttgatcctggctcaggacgaacgctggcggcgtgcctaatacatgcaagtcgaacgcacagatatcaacagaagctgcttgcagtggaagttaattgatgtgagtggcggacgggtgagtaacacgtgggtaacctacccaaaagtgggggataacatttggaaacagatgctaataccgcataatttaagtgaccacatggtcacttaatgaaagatggtttcggctatcacttttggatggacccgcggcgtattagctagttggtgggataacggcctaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttggagaagaacagggactagagtaactgttagtcctatgacggtatccaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccgaagaagtgcattagaaactgggaaacttgagtgcagaagaggagagtggaactccatgtgtagcggtgaaatgcgtagatatatggaagaacaccagtggcgaaggcggctctctggtctgtaactgacgctgaggctcgaaagtatggggagcgaacaggattagataccctggtagtccataccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatcctttgaccactgtagagatacagctttcccttcggggacaaagtgacaggtggtgcatggttgtcgtcagctcgtgtcgtgagatgttgggttaagtcccgcaacgagcgcaacccttatgactagttgccagcattaagttgggcactctagtgagactgccggtgacaaaccggaggaaggtggggatgacgtcaaatcagcatgccccttatgacctgggctacacacgtgctacaatggttggtacaacgagttgcgaacccgcgagggtaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccatgagagtttgtaacacccgaagccggtggggtaacctctatgaggagctaaccgtctaaggtgggacagatgattggggtgaagtcgtaacaaggtagccgtaggagaacctgcggctggatcacctcctttctaaggaa

SEQ ID NO: 4643 - DNA, 1575 bp, Lactobacillus bambusae
  ref <308>: DATABASE ACCESSION NUMBER: NCBI ACCESSION: NZ_QCXQ01000004.1
  ref <309>: DATABASE ENTRY DATE: 2019-04-01
  ref <313>: RELEVANT RESIDUES IN SEQ ID NO: (1)..(1575)
taagatgagagtttgatcctggctcaggacgaacgctggcggcatgcctaatacatgcaagtcgaacgagtctccgttaactgaagtgcttgcacggacgctaacatcgagacgagtggcgaactggtgagtaacacgtgggaaacctgcccagaagaaggggataacacttggaaacaggtgctaataccgtataacaacttggaccgcatggtccgagtttgaaagatggctccggctatcacttctggatggtcccgcggcgcattagctagatggcggtgtaatggaccaccatggcaatgatgcgtagccgacctgagagggtaatcggccacattgggactgagacacggcccagactcctacgggaggcagcagtagggaatcttccacaatggacgaaagtctgatggagcaatgccgcgtgagtgaagaagggtttcggctcgtaaaactctgttgttagagaagaacgtgggtgagagtaactgttcacccagtgacggtatctaaccagaaagccacggctaactacgtgccagcagccgcggtaatacgtaggtggcaagcgttgtccggatttattgggcgtaaagcgagcgcaggcggtttgttaagttcgatgtgaaagccttcggctcaaccgaagaagtgcatcgaaaactggcagacttgagtgcaggaaagggtagtggaactccatgtgtagcggtgaaatgcgtagatatatggaagaacaccagtggcgaaggcggctacctggtctgtaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatcttctgccagcttcagagatgaagtgttcccttcggggacagaatgacaggtggtgcatggttgtcgtcagctcgtgtcgtgagatgttgggttaagtcccgcaacgagcgcaacccctattgtcagttgccagcattcagttgggcactctggcgagactgccggtgacaaaccggaggaaggtggggatgacgtcaaatcatcatgccccttatgacctgggctacacacgtgctacaatggatggtacaacgagtcgcaaagtcgcgaggccaagctaatctcttaaagccattctcagttcggactgcagtctgcaactcgactgcacgaagtcggaatcgctagtaatcgcggatcagcatgccgcggtgaatacgttcccgggccttgtacacaccgcccgtcacaccatgagagtttgtaacacccaaagtcggtgaggtaacctttatggggccagccgcctaaggtgggacagatgattagggtgaagtcgtaacaaggtagccgtaggagaacctgcggctggatcacctcctttctaaggaa

SEQ ID NO: 4644 - DNA, 1427 bp, Lactobacillus bifermentans
  ref <308>: DATABASE ACCESSION NUMBER: NCBI ACCESSION: NZ_AZDA01000105.1
  ref <309>: DATABASE ENTRY DATE: 2019-04-01
  ref <313>: RELEVANT RESIDUES IN SEQ ID NO: (1)..(1427)
tatatgagagtttgatcctggctcaggacgaacgctggcggcgtgcctaatacatgcaagtcgaacgcactgacgtcgacagaaggtgcttgcactggaagttgattgacgtgagtggcggacgggtgagtaacacgtgggtaacctgcccttaagcgggggataacatttggaaacagatgctaataccgcataaaagttgagatcacatggtcttaatttgaaagacggcctttggctgtcacttaaggatggacccgcggcgtattagctagttggtgagataatagcccaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttggagaagaacagggactagagtaactgttagtcctttgacggtatccaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccgaagaagtgcatcagatactgggaaacttgagtgcagaagaggaaagtggaactccatgtgtagcggtgaaatgcgtagatatatggaagaacaccagtggcgaaggcggctttctggtctgtaactgacgctgaggctcgaaagtatggggagcgaacaggattagataccctggtagtccataccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatctagcgccaatcctagagataggacgttcccttcggggacgctaagacaggtggtgcatggttgtcgtcagctcgtgtcgtgagatgttgggttaagtcccgcaacgagcgcaacccttatgattagttgccagcatttagttgggcactctaatcagactgccggtgacaaaccggaggaaggtggggatgacgtcaaatcagcatgccccttatgacctgggctacacacgtgctacaatggctagtacaacgagttgcgaacccgcgagggtaagctaatctcttaaagctagtctcagttcggattgtaggctgcaactcgcctacatgaagtcggaatcgctagtaatcgcggatcagcacgccgcggtgaatacgttcccgggccttgtacacaccgcc

SEQ ID NO: 4645 - DNA, 1566 bp, Lactobacillus bombi
  ref <308>: DATABASE ACCESSION NUMBER: NCBI ACCESSION: NZ_CP031513.1
  ref <309>: DATABASE ENTRY DATE: 2019-04-01
  ref <313>: RELEVANT RESIDUES IN SEQ ID NO: (1)..(1566)
aaaaatgagagtttgatcctggctcaggacgaacgctggcggcgtgcctaatacatgcaagtcgagcgagtgaagttaaggaagccttcgggcggaattaatggaacgagcggcggatgggtgagtaacacgtaggtaacctaccctaaagcgggggataccatctggaaacaggtgctaataccgcataaaccttctggtcacatgacgagaagttgaaagacggtttcggctgtcactttaggatggacctgcggcgtattagctagttggtggagtaacggttcaccaaggcaatgatacgtagccgacctgagagggtaatcggccacattgggactgagacacggcccaaactcctacgggaggcagcagtagggaatcttccacaatggacgcaagtctgatggagcaacgccgcgtggatgaagaaggttttcggatcgtaaaatcctgttgttgaagaagaacgggtgtgagagtaactgctcacatcgtgacggtaatcaaccagaaagtcacggctaactacgtgccagcagccgcggtaatacgtaggtggcaagcgttgtccggatttattgggcgtaaagggagcgcaggcggtctgttaagtctgaatgtgaaagccctcagcttaactgaggaagagcatcagaaactggcagacttgagtgcagaagaggagagtggaactccatgtgtagcggtgaaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctcctgcaagtctaagagattagaggttcccttcggggacaggaagacaggtggtgcatggttgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcaaatcatcatgccccttatgacctgggctacacacgtgctacaatggatggtacaatgagaagcgaactcgcgagggcaagcagatctcttaaaaccattctcagttcggattgcaggctgcaactcgcctgcatgaagctggaatcgctagtaatcgcggatcagcatgccgcggtgaatacgttcccgggccttgtacacaccgcccgtcacaccatgagagtttgtaacacccaaagccggtggggtaacccgtaagggagccagccgtctaaggtgggacaaatgattagggtgaagtcgtaacaaggtagccgtaggagaacctgcggctggatcacctcctttcta

SEQ ID NO: 4646 - DNA, 1582 bp, Lactobacillus brantae
  ref <308>: DATABASE ACCESSION NUMBER: NCBI ACCESSION: NZ_AYZQ01000010.1
  ref <309>: DATABASE ENTRY DATE: 2019-04-01
  ref <313>: RELEVANT RESIDUES IN SEQ ID NO: (1)..(1582)
tttatatgagagtttgatcctggctcaggatgaacgctggcggcgtgcctaatacatgcaagtcgaacgagttcgcgtttatgatggcggtgcttgcaccaatagattaaacatttgaacgagtggcggacgggtgagtaacacgtgggtaacctgccctaaagtgggggataacatttggaaacagatgctaataccgcataaacctcaaaagcacatgcttttgagttgaaagatggcgtaagctatcgcttttggatggacccgcggcgtattagctagttggtgaggtaaaggctcaccaaggctgtgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttggagaagaacgtacgtgagagtaactgttcacgtagtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggctcaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagttgcgagaccgcgaggtttagctaatctcttaaagccattctcagtccggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggggtaaccttttaggagctagccgtctaaggtgggacagatgattagggtgaagtcgtaacaaggtagccgtaggagaacctgcggctggatcacctcctttctaaggaa

SEQ ID NO: 4647 - DNA, 1574 bp, Lactobacillus brevis
  ref <308>: DATABASE ACCESSION NUMBER: NCBI ACCESSION: NZ_LS483405.1
  ref <309>: DATABASE ENTRY DATE: 2019-04-01
  ref <313>: RELEVANT RESIDUES IN SEQ ID NO: (1)..(1574)
taagatgagagtttgatcctggctcaggacgaacgctggcggcatgcctaatacatgcaagtcgaacgagcttccgttgaatgacgtgcttgcactgatttcaacaatgaagcgagtggcgaactggtgagtaacacgtgggaaatctgcccagaagcaggggataacacttggaaacaggtgctaataccgtataacaacaaaatccgcatggattttgtttgaaaggtggcttcggctatcacttctggatgatcccgcggcgtattagttagttggtgaggtaaaggcccaccaagacgatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacctttgagagtaactgttcaagggttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatcttagagataagacgttcccttcggggacagaatgacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4648 - DNA, 1479 bp, Lactobacillus buchneri
  ref <308>: DATABASE ACCESSION NUMBER: NCBI ACCESSION: NZ_AZDM01000072.1
  ref <309>: DATABASE ENTRY DATE: 2019-04-01
  ref <313>: RELEVANT RESIDUES IN SEQ ID NO: (1)..(1479)
agatttaacattgagacgagtggcgaactggtgagtaacacgtgggtaacctgcccttgaagtaggggataacacttggaaacaggtgctaataccgtataacaaccaaaaccacctggttttggtttaaaagacggcttcggctgtcactttaggatggacccgcggcgtattagcttgttggtaaggtaacggcctaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtcagagtaactgttgacatcttgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcggggaccagccgtctaaggtgggacagatgattagggtgaagtcgtaacaaggtagccgtaggagaacctgcggctggatcacctcctttctaaggaa

SEQ ID NO: 4649 - DNA, 1566 bp, Lactobacillus cacaonum
  ref <308>: DATABASE ACCESSION NUMBER: NCBI ACCESSION: NZ_AYZE01000006.1
  ref <309>: DATABASE ENTRY DATE: 2019-04-01
  ref <313>: RELEVANT RESIDUES IN SEQ ID NO: (1)..(1566)
taaaatgagagtttgatcctggctcaggacgaacgctggcggcgtgcctaatacatgcaagtcgaacgcaaaactttcaccgaatgcttgcattcaccgaaagttttgagtggcgaacgggtgagtaacacgtgggtaacctgcccagaagagggggataacacttggaaacaggtgctaataccgcataataataaaaaccacatggtttttatttgaaagatggttatgctatcacttctggatggacccgcggcgtattagctagttggtaaggtaatggcttaccaaggcgatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtatgtgagagtaactgctcatgtagtgacggtatctaaccagaaagccacggctaactacgtgccagcagccgcggtaatacgtaggtggcaagcgttgtccggatttattgggcgtaaagggaacgcaggcggttttttaagtctgatgtgaaagccttcggctcaaccgaagtcgtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagtgtgggtagcaaacaggattagataccctggtagtccacaccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttctgacaacctaagagattaggtgttcccttcggggacagaatgacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggatgacgtcaaatcatcatgccccttatgacctgggctacacacgtgctacaatggacggtacaacgagtcgcgaaaccgcgaggtttagctaatctcttaaagccgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtgaggtaaccaataggagccagccgtctaaggtgggacagatgattggggtgaagtcgtaacaaggtagccgtaggagaacctgcggctggatcacctcctttctaagga

SEQ ID NO: 4650 - DNA, 1583 bp, Lactobacillus camelliae
  ref <308>: DATABASE ACCESSION NUMBER: NCBI ACCESSION: NZ_AYZJ01000044.1
  ref <309>: DATABASE ENTRY DATE: 2019-04-01
  ref <313>: RELEVANT RESIDUES IN SEQ ID NO: (1)..(1583)
tttatatgagagtttgatcctggctcaggatgaacgctggcggcgtgcctaatacatgcaagtcgaacgaggcgttgatgattgactgaggtgcttgcaccgaaggattttattaacaccgagtggcggacgggtgagtaacacgtgggtaacctgcccttaagtgggggataacatttggaaacagatgctaataccgcataaacccttagaccacatggtctttggttgaaagatggcgtaagctatcgcttttggatggacccgcggcgtattagctagttggtaaggtaacggcctaccaaggcaatgatacgtagccgaactgagaggttgatcggccacaatgggactgagacacggcccatactcctacgggaggcagcagtagggaatcttccacaatggacgcaagtctgatggagcaacgccgcgtgagtgaagaaggctttcgggtcgtaaaactctgttgttggagaagaacacgtttgagagtaactgttcagacgttgacggtatccaaccagaaagccacggctaactacgtgccagcagccgcggtaatacgtaggtggcaagcgttatccggatttattgggcgtaaagcgagcgcaggcggtttcttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgacgcaacgcgaagaaccttaccaggtcttgacatcctatgccaacctgagagatcaggcgttcccttcggggacatagtgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggacgacgtcaaatcatcatgccccttatgacctgggctacacacgtgctacaatggccggtacaacgagttgcgaacccgcgagggtaagctaatctcttaaagccggtctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccgaagccggtggggtaacctctttgaggagctagccgtctaaggtgggacagatgattagggtgaagtcgtaacaaggtagccgtaggagaacctgcggctggatcacctcctttctaagga

SEQ ID NO: 4651 - DNA, 1566 bp, Lactobacillus capillatus
  ref <308>: DATABASE ACCESSION NUMBER: NCBI ACCESSION: NZ_AZEF01000036.1
  ref <309>: DATABASE ENTRY DATE: 2019-04-01
  ref <313>: RELEVANT RESIDUES IN SEQ ID NO: (1)..(1566)
taaaatgagagtttgatcctggctcaggacgaacgctggcggcgtgcctaatacatgcaagtcgtacgcaaatctttcaccgaatgcttgcattcatcgaaagatttgagtggcgaacgggtgagtaacacgtgggtaacctgcccagaagaaggggataacacttggaaacaggtgctaataccgtataacaacaaaaaccgcctggtttttgtttaaaagatggttctgctatcacttctggatggacccgcggcgtattagctagttggtgaggtaatggctcaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtgtgtgagagtaactgttcatgcagtgacggtatctaaccagaaagccacggctaactacgtgccagcagccgcggtaatacgtaggtggcaagcgttgtccggatttattgggcgtaaagggaacgcaggcggttttttaagtctgatgtgaaagccttcggcttaaccgaagtcgtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcatgggtagcaaacaggattagataccctggtagtccatgccgtaaacgatgaatgctaagtgttggagggtttccgcccttcagtgctgcagttaacgcattaagcattccgcctggggagtacgatcgcaagattgaaactcaaaggaattgacgggggcccgcacaagcggtggagcatgtggtttaattcgaagcaacgcgaagaaccttaccaggtcttgacatcttctgccaatctaagagattagatgttcccttcggggacagaatgacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggatgacgtcaaatcatcatgccccttatgacctgggctacacacgtgctacaatggacagtacaacgagtcgcaagaccgcgaggtcaagctaatctcttaaaactgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtgaggtaaccttttggagccagccgtctaaggtgggacagatgattggggtgaagtcgtaacaaggtagccgtaggagaacctgcggctggatcacctcctttctaagga

SEQ ID NO: 4652 - DNA, 1579 bp, Lactobacillus casei
  ref <308>: DATABASE ACCESSION NUMBER: NCBI ACCESSION: NZ_LS991421.1
  ref <309>: DATABASE ENTRY DATE: 2019-04-01
  ref <313>: RELEVANT RESIDUES IN SEQ ID NO: (1)..(1579)
tttatatgagagtttgatcctggctcaggatgaacgctggcggcgtgcctaatacatgcaagtcgaacgagttttggtcgatgaacggtgcttgcatcgtgattcaacttaaaacgagtggcggacgggtgagtaacacgtgggtaacctgcccttaagtgggggacaacatttggaaacagatgctaataccgcataaatccaagaaccgcatggttcttggctgaaagatggcgtaagctatcgcttttggatggacccgcggcgtattagctagttggtgaggtaacggctcaccaaggccatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4653 - DNA, 1575 bp, Lactobacillus cerevisiae
  ref <308>: DATABASE ACCESSION NUMBER: NCBI ACCESSION: NZ_RHNN01000057.1
  ref <309>: DATABASE ENTRY DATE: 2019-04-01
  ref <313>: RELEVANT RESIDUES IN SEQ ID NO: (1)..(1575)
ttaagatgagagtttgatcctggctcaggacgaacgctggcggcatgcctaatacatgcaagtcgaacgagcttccgttgaatgacgtgcttgcactgattttaacaatgaagcgagtggcgaactggtgagtaacacgtgggaaatctgcccagaagcaggggataacacttggaaacaggtgctaataccgtataacaacaagaaccgcatggttcttgtttgaaaggtggcttcggctatcacttctggatgatcccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacttctgagagtaactgttcagaagttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggtaacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4654 - DNA, 1573 bp, Lactobacillus ceti
  ref <308>: DATABASE ACCESSION NUMBER: NCBI ACCESSION: NZ_JQBZ01000004.1
  ref <309>: DATABASE ENTRY DATE: 2019-04-01
  ref <313>: RELEVANT RESIDUES IN SEQ ID NO: (1)..(1573)
aaattgagagtttgatcctggctcaggacgaacgctggcggcgtgcctaatacatgcaagtcgagcgcaaagttttatcaccggatgcttgcatccaccgataaaactttgagcggcggacgggtgagtaacacgtgggtaacctgcccaaaagagggggataacatctggaaacaggtgctaataccgcataactcaaggaaccgcatggttctttgataaaagatggtttcggctatcacttttggatggacccgcggtgcattagctagttggtaaggtaatggcttaccaaggcgatgatgcatagccgaactgagaggttgatcggccacattgggactgagacacggcccagactcctacgggaggcagcagtagggaatcttccacaatggacgaaagtctgatggagcaacgccgcgtgagtgaagaaggtcttcggatcgtaaaactctgttgttagaaaagaacaaggatgagagtaactgctcatcccctgacagtatctaaccagaaagccacggctaactacgtgccagcagccgcggtaatacgtaggtggcaagcgttgtccggatttattgggcgtaaaggggacgcaggcggtcttttaagtctgatgtgaaagccttcggcttaaccgaagtagtgcattggaaactggaagacttgagtgtagaagaggagagtggaactccatgtgtagcggtgaaatgcgtagatatatggaagaacaccagtggcgaaagcggctctctggtctacaactgacgctgaggtccgaaagcgtgggtagcaaacaggattagataccctggtagtccacgctgtaaacgatgaatgctaggtgttggagggtttccgcccttcagtgccgcagctaacgcactaagcattccgcctggggagtacgatcgcaagattgaaactcaaaggaattgacgggggcccgcacaagcggtggagcatgtggtttaattcgaagcaacgcgaagaaccttaccaggtcttgacatcttctgacaacctaagagattaggcgttcccttcggggacagaatgacaggtggtgcatggttgtcgtcagctcgtgtcgtgagatgttgggttaagtcccgcaacgagcgcaacccttattgtcagttgccagcattcagttgggcactctggcgagactgccggtgacaaaccggaggaaggtggggatgacgtcaaatcatcatgccccttatgacctgggctacacacgtgctacaatggataatacaacgagttgcgagaccgcgaggtttagctaatctcttaaaattattctcagttcggattgcaggctgcaactcgcctgcatgaagtcggaatcgctagtaatcgcgaatcagcatgtcgcggtgaattcgttcccgggccttgtacacaccgcccgtcacaccatgagagtttgtaacacccaaagccggtggggtaacctttataggagctagccgtctaaggtgggacagatgattagggtgaagtcgtaacaaggtagccgtaggagaacctgcggctggatcacctcctttctaaggaa

SEQ ID NO: 4655 - DNA, 1579 bp, Lactobacillus coleohominis
  ref <308>: DATABASE ACCESSION NUMBER: NCBI ACCESSION: NZ_GG698808.1
  ref <309>: DATABASE ENTRY DATE: 2019-04-01
  ref <313>: RELEVANT RESIDUES IN SEQ ID NO: (1)..(1579)
ttaatatgagagtttgatcctggctcaggatgaacgccggcggtgtgcctaatacatgcaagtcgaacgcgttggcccgactgattgatgatgcttgcatcagattgacgacggtttaccaacgagtggcggacgggtgagtaacacgtaggcaacctgcccagaagcgggggacaacatttggaaacaagtgctaataccgcataacaacgaaaactgcctggttttcgtttaaaagatggtttcggctatcacttctggatgggcctgcggcgcattagctagttggtaaggcaacggcttaccaaggcagtgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttgaagaagaacgtgcgtgagagtaactgttcacgcagtgacggtattcaaccagaaagtcacggctaactacgtgccagcagccgcggtaatacgtaggtggcaagcgttatccggatttattgggcgtaaagcgagcgcaggcggttttctaagtctgatgtgaaagccttcggcttaaccggagaagggcatcggaaactggataacttgagtgcaagagaggacagtggaactccatgtgtagcggtggaatgcgtagatatatggaagaacaccagtggcgaaggcggctgtctagcttgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaacctcagagatgaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagcagcgaactcgcaagggccagctaatctcttaaaaccgttctcagttcggactgcagtctgcaactcgactgcacgaagtcggaatcgctagtaatcgcggatcagcatgccgcggtgaatacgttcccgggccttgtacacaccgcccgtcacaccatgggagtttgcaatgcccaaagccggtggcctaaccttcgggaaggagccgtctaaggcagggcagatgactggggtgaagtcgtaacaaggtagccgtaggagaacctgcggctggatcacctcctttcta

SEQ ID NO: 4656 - DNA, 1573 bp, Lactobacillus collinoides
  ref <308>: DATABASE ACCESSION NUMBER: NCBI ACCESSION: NZ_JYDC01000041.1
  ref <309>: DATABASE ENTRY DATE: 2019-04-01
  ref <313>: RELEVANT RESIDUES IN SEQ ID NO: (1)..(1573)
ataaaatgagagtttgatcctggctcaggatgaacgctggcggcgtgcctaatacatgcaagtcgaacgcatcccgttaaatgaagtgcttgcacggattttaacattggatgagtggcgaactggtgagtaacacgtgggtaacctgcccagaagcaggggataacacttggaaacaggtgctaataccgtataacaacaaaaaccgcatggtttttgtttgaaaggtggtttcggctatcacttctggatggacccgcggcgtattagctagttggtggagtaatggttcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacacgtttgagagtaactgttcagacgttgacggtattcaaccagaaagccacggctaactacgtgccagcagccgcggtaatacgtaggtggcaagcgttatccggatttattgggcgtaaagcgagcgcaggcggttacttaagtctgatgtgaaagccttcggcttaaccggagaagtgcatcggaaactgggtaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatactgtgctaacctaagagattaggcgttcccttcggggacgcagatacaggtggtgcatggctgtcgtcagctcgtgtcgtgagatgttgggttaagtcccgcaacgagcgcaacccttattgtcagttgccagcatttagttgggcactctggcgagactgccggtgacaaaccggaggaaggtggggatgacgtcaagtcatcatgccccttatgacctgggctacacacgtgctacaatggatggtacaacgagttgcgaactcgcgagagcaagctaatctcttaaagccattctcagttcggactgtaggctgcaactcgcctacacgaagtcggaatcgctagtaatcgcggatcagcatgccgcggtgaatacgttcccgggccttgtacacaccgcccgtcacaccatgagagtttgcaacacccaaagtcggttcggtaaccttcgggagccaaccgcctaaggtggggcagatgattagggtgaagtcgtaacaaggtagccgtaggagaacctgcggctggatcacctcctttctaaggaa

SEQ ID NO: 4657 - DNA, 1570 bp, Lactobacillus composti
  ref <308>: DATABASE ACCESSION NUMBER: NCBI ACCESSION: NZ_AZGA01000039.1
  ref <309>: DATABASE ENTRY DATE: 2019-04-01
  ref <313>: RELEVANT RESIDUES IN SEQ ID NO: (1)..(1570)
tttatttgagagtttgatcctggctcaggacgaacgctggcggcgtgcctaatacatgcaagtcgaacgagcttttcctaccgagtgcttgcactcatttggaaaggcgagtggcggacgggtgagtaacacgtgggcaacctaccctagagcgggggataacatttggaaacagatgctaataccgcataacaatttgaacctcatggttcgaatttaaaagatggtttcggctatcactttaggatgggcccgcggcgtattagccagttggtggggtaaaggcctaccaaagctatgatacgtagccgacctgagagggtgatcggccacattgggactgagacacggcccaaactcctacgggaggcagcagtagggaatcttccacaatggacgaaagtctgatggagcaacgccgcgtgagtgaagaagggtttcggctcgtaaaactctgttatcggagaagaataggggtaagagtaactgtttacctcctgacggtatccgaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtgtgggtagcaaacaggattagataccctggtagtccacaccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgccagcctaagagattaggtgttcccttcggggacaaaatgacaggtggtgcatggttgtcgtcagctcgtgtcgtgagatgttgggttaagtcccgcaacgagcgcaacccttataattagttgccagcattcagttgggcactctagttagactgccggtgacaaaccggaggaaggtggggatgacgtcaaatcatcatgccccttatgacctgggctacacacgtgctacaatggatggtacaacgagtcgctagaccgcgaggtcatgctaatctcttaaaaccattctcagttcggattgtaggctgcaactcgcctacatgaagctggaatcgctagtaatcgcggatcagcacgccgcggtgaatacgttcccgggccttgtacacaccgcccgtcacaccatgagagtttgtaacgcccaaagccggtagggtaaccttttaggagccagccgtctaaggcgggacagatgattagggtgaagtcgtaacaaggtagccgtaggagaacctgcggctggatcacctcctttctaaggaa

SEQ ID NO: 4658 - DNA, 1582 bp, Lactobacillus concavus
  ref <308>: DATABASE ACCESSION NUMBER: NCBI ACCESSION: NZ_AZFX01000066.1
  ref <309>: DATABASE ENTRY DATE: 2019-04-01
  ref <313>: RELEVANT RESIDUES IN SEQ ID NO: (1)..(1582)
ttatatgagagtttgatcctggctcaggacgaacgctggcggcgtgcctaatacatgcaagtcgaacgagtttcattttaaggatcaaggtgcttgcaccgagagaattaaaaagaaacgagtggcggacgggtgagtaacacgtgggtaacctaccctaaagtgggggataacatttggaaacagatgctaataccgcataacgaacgaaaccacatggtttcgttctgaaagatggcgtaagctatcacttttggatggacccgcggcgtattagctagttggtgaggtaacggctcaccaaggcgatgatacgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaaactctgttatcggagaagaacgtatctggtagtaactggccaggtagtgacggtatccgatcagaaagccacggctaactacgtgccagcagccgcggtaatacgtaggtggcaagcgttgtccggatttattgggcgtaaagcgagtgcaggcggttttttaagtctgatgtgaaagccttcggcttaaccgaagaaatgcattggaaactggggaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggggggtttccgcccctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcctagagataggacgttcccttcggggacgctaagacaggtggtgcatggttgtcgtcagctcgtgtcgtgagatgttgggttaagtcccgcaacgagcgcaacccttatgattagttgccagcattaagttgggcactctagtcagactgccggtgacaaaccggaggaaggtggggatgacgtcaaatcatcatgccccttatgacctgggctacacacgtgctacaatggctagtacaacgagttgcgagaccgcgaggtcaagctaatctctaaaagctagtctcagttcggattgtaggctgcaactcgcctacatgaagttggaatcgctagtaatcgcggatcagcacgccgcggtgaatacgttcccgggccttgtacacaccgcccgtcacaccatgagagtttgtaacacccaaagccggtgaggtaacccgtaagggagctagccgtctaaggtgggacagatgattagggtgaagtcgtaacaaggtagccgtaggagaacctgcggctggatcacctcctttctaaggaa

SEQ ID NO: 4659 - DNA, 1579 bp, Lactobacillus coryniformis
  ref <308>: DATABASE ACCESSION NUMBER: NCBI ACCESSION: NZ_CP017697.1
  ref <309>: DATABASE ENTRY DATE: 2019-04-01
  ref <313>: RELEVANT RESIDUES IN SEQ ID NO: (1)..(1579)
tttatatgagagtttgatcctggctcaggacgaacgctggcggcgtgcctaatacatgcaagtcgaacgcactgacgtcgaccgaagctgcttgcagtggacgttgattgacgtgagtggcggacgggtgagtaacacgtgggtaacctacccttaagcgggggataacatttggaaacagatgctaataccgcataaccattcagaccacatggcctgaatgtaaaagacggcctttggctgtcacttttggacggacccgcggcgtattagttagttggtaaggtaacggcttaccaagacaatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttaggatcgtaaaactctgttgttggagaagaacagggactagagtaactgttagtcctttgacggtatccaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccgaagaagtgcattagaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatggggagcgaacaggattagataccctggtagtccataccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcctttgaccactgtagagatacagctttcccttcggggacaaagtgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcagcatgccccttatgacctgggctacacacgtgctacaatggtcggtacaacgagttgcgaacccgcgagggtaagctaatctcttaaagccgatctcagttcggattgtaggctgcaactcgcctacatgaagccggaatcgctagtaatcgcggatcagcacgccgcggtgaatacgttcccgggccttgtacacaccgcccgtcacaccatgagagtttgtaacacccgaagtcggtggggtaacccttttagggaactagccgcctaaggtgggacagatgattggggtgaagtcgtaacaaggtagccgtaggagaacctgcggctggatcacctcctttctaaggaa

SEQ ID NO: 4660 - DNA, 1573 bp, Lactobacillus crispatus
  ref <308>: DATABASE ACCESSION NUMBER: NCBI ACCESSION: NZ_SCLX01000114.1
  ref <309>: DATABASE ENTRY DATE: 2019-04-01
  ref <313>: RELEVANT RESIDUES IN SEQ ID NO: (1)..(1573)
ttaaaatgagagtttgatcctggctcaggacgaacgctggcggcgtgcctaatacatgcaagtcgagcgagcggaactaacagatttacttcggtaatgacgttaggaaagcgagcggcggatgggtgagtaacacgtgggaaacctgccccatagtctgggataccacttggaaacaggtgctaataccggataagaaagcagatcgcatgatcagcttttaaaaggcggcgtaagctgtcgctatgggatggccccgcggtgcattagctagttggtaaggtaaaggcttaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatttgtagagatacaaagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcgagcctgcgaaggcaagcggatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccttcgggaaggagccgtctaaggcagggcagatgactggggtgaagtcgtaacaaggtagccgtaggagaacctgcggctggatcacctcctttctaaggaa

SEQ ID NO: 4661 - DNA, 1574 bp, Lactobacillus crustorum
  ref <308>: DATABASE ACCESSION NUMBER: NCBI ACCESSION: NZ_CP017996.1
  ref <309>: DATABASE ENTRY DATE: 2019-04-01
  ref <313>: RELEVANT RESIDUES IN SEQ ID NO: (1)..(1574)
taatatgagagtttgatcctggctcaggacgaacgctggcggcatgcctaatacatgcaagtcgaacgaaccatcctgaagattgaagcttgcttcatgattcagaccttggtgagtggcggacgggtgagtaacacgtgggtaacctgcccaaaagtgggggataacatctggaaacaggtgctaataccgcataacaactactttctcatgatcgtagcttgaaagatggctctgctatcgcttttggatggacccgcggcgtattagctagttggtgaggtaatagctcaccaaggcaatgatacgtagccgacctgagagggtaatcggccacattgggactgagacacggcccaaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgctttgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgcggctggatcacctcctttctaagga

SEQ ID NO: 4662 - DNA, 1584 bp, Lactobacillus curieae
  ref <308>: DATABASE ACCESSION NUMBER: NCBI ACCESSION: NZ_BEXA01000017.1
  ref <309>: DATABASE ENTRY DATE: 2019-04-01
  ref <313>: RELEVANT RESIDUES IN SEQ ID NO: (1)..(1584)
ttaaaatgagagtttgatcctggctcaggacgaacgctggcggcgtgcctaatacatgcaagtcgaacgcgtctacgttaatgaaatcaatgtgcttgcactgcgatggatttaacattagacgagtggcgaactggtgagtaacacgtgggtaacctgccctcaagcaggggataacacttggaaacaggtgctaataccgtataacaacaaaaaccgcatggtttttgtttgaaagatggtttcggctatcacttgaggatggacccgcggcgtattagctagttggtgaggtaatggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttaaagaagaacaggtgtaagagtaactgtttacaccgtgacggtatttaaccagaaagccacggctaactacgtgccagcagccgcggtaatacgtaggtggcaagcgttgtccggatttattgggcgtaaagcgagcgcaggcggtcttttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgctaacccaagagattgggcgttcccttcggggacggaatgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggtggggacgacgtcaaatcatcatgccccttatgacctgggctacacacgtgctacaatggacggtacaacgagtcgcgaaaccgcgaggtcaagctaatctcttaaagccgttctcagttcggattgcaggctgcaactcgcctgcatgaagttggaatcgctagtaatcgtggatcagcatgccacggtgaatacgttcccgggccttgtacacaccgcccgtcacaccatgagagtttgtaacacccaaagtcggtgaggtaaccttttggagccagccgcctaaggtgggacagatgattagggtgaagtcgtaacaaggtagccgtaggagaacctgcggctggatcacctcctttctaaggaa

SEQ ID NO: 4663 - DNA, 1574 bp, Lactobacillus curvatus
  ref <308>: DATABASE ACCESSION NUMBER: NCBI ACCESSION: NZ_LT841333.1
  ref <309>: DATABASE ENTRY DATE: 2019-04-01
  ref <313>: RELEVANT RESIDUES IN SEQ ID NO: (1)..(1574)
tcgagagtttgatcctggctcaggacgaacgctggcggcgtgcctaatacatgcaagtcgaacgcactctcgttagattgaagaagcttgcttctgattgataacatttgagtgagtggcggacgggtgagtaacacgtgggtaacctgccctaaagtgggggataacatttggaaacagatgctaataccgcataaaacctagcaccgcatggtgcaaggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaacgtatttgatagtaactgatcaggtagtgacggtatccaaccagaaagccacggctaactacgtgccagcagccgcggtaatacgtaggtggcaagcgttgtccggatttattgggcgtaaagcgagcgcaggcggtttcttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagtcgcgagaccgcgaggtttagctaatctcttaaaaccattctcagttcggattgtaggctgcaactcgcctacatgaagccggaatcgctagtaatcgcggatcagcatgccgcggtgaatacgttcccgggccttgtacacaccgcccgtcacaccatgagagtttgtaacacccaaagccggtgaggtaaccttcgggagccagccgtctaaggtgggacagatgattagggtgaagtcgtaacaaggtagccgtaggagaacctgcggctggatcacctcctttctaaggaa

SEQ ID NO: 4664 - DNA, 1573 bp, Lactobacillus delbrueckii
  ref <308>: DATABASE ACCESSION NUMBER: NCBI ACCESSION: NZ_LS991409.1
  ref <309>: DATABASE ENTRY DATE: 2019-04-01
  ref <313>: RELEVANT RESIDUES IN SEQ ID NO: (1)..(1573)
ttaaattgagagtttgatcctggctcaggacgaacgctggcggcgtgcctaatacatgcaagtcgagcgagctgaattcaaagatcccttcggggtgatttgttggatgctagcggcggatgggtgagtaacacgtgggcaatctgccctaaagactgggataccacttggaaacaggtgctaataccggataacaacatgaatcgcatgattcaagtttgaaaggcggcgcaagctgtcactttaggatgagcccgcggcgcattagctagttggtggggtaaaggcctaccaaggcaatgatgcgtagccgagttgagagactgatcggccacattgggactgagacacggcccaaactcctacgggaggcagcagtagggaatcttccacaatggacgcaagtctgatggagcaacgccgcgtgagtgaagaaggtcttcggatcgtaaagctctgttgttggtgaagaaggatagaggcagtaactggtctttatttgacggtaatcaaccagaaagtcacggctaactacgtgccagcagccgcggtaatacgtaggtggcaagcgttgtccggatttattgggcgtaaagcgagcgcaggcggaatgataagtctgatgtgaaagcccacggctcaaccgtggaactgcatcggaaactgtcattcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagcgctaggtgttggggactttccggtcctcagtgccgcagcaaacgcattaagcgctccgcctggggagtacgaccgcaaggttgaaactcaaaggaattgacgggggcccgcacaagcggtggagcatgtggtttaattcgaagcaacgcgaagaaccttaccaggtcttgacatcctgcgctacacctagagataggtggttcccttcggggacgcagagacaggtggtgcatggctgtcgtcagctcgtgtcgtgagatgttgggttaagtcccgcaacgagcgcaacccttgtctttagttgccatcattaagttgggcactctaaagagactgccggtgacaaaccggaggaaggtggggatgacgtcaagtcatcatgccccttatgacctgggctacacacgtgctacaatgggcagtacaacgagaagcgaacccgcgagggtaagcggatctcttaaagctgttctcagttcggactgcaggctgcaactcgcctgcacgaagctggaatcgctagtaatcgcggatcagcacgccgcggtgaatacgttcccgggccttgtacacaccgcccgtcacaccatggaagtctgcaatgcccaaagtcggtgggataacctttataggagtcagccgcctaaggcagggcagatgactggggtgaagtcgtaacaaggtagccgtaggagaacctgcggctggatcacctcctttctaaggaa

SEQ ID NO: 4665 - DNA, 1582 bp, Lactobacillus dextrinicus
  ref <308>: DATABASE ACCESSION NUMBER: NCBI ACCESSION: NZ_AYYK01000012.1
  ref <309>: DATABASE ENTRY DATE: 2019-04-01
  ref <313>: RELEVANT RESIDUES IN SEQ ID NO: (1)..(1582)
ttatatgagagtttgatcctggctcaggacgaacgctggcggcgtgcctaatacatgcaagtcgaacgagtttgcttttaatgaaggcggtgcttgcaccaactgatttaaaaataaacgagtggcggacgggtgagtaacacgtgggtaacctaccctaaagtgggggataacatttggaaacagatgctaataccgcataatattaaaaaccacatggtttttaattgaaagacggcgtaagctgtcacttttggatggacccgcggcgtattagctagttggtgaggtaacggctcaccaaggcgatgatacgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaaactctgttattggagaagaacgtatttggtagtaactggccagatagtgacggtatccaatcagaaagccacggctaactacgtgccagcagccgcggtaatacgtaggtggcaagcgttgtccggatttattgggcgtaaagcgagtgcaggcggttttttaagtctgatgtgaaagccttcggcttaaccgaagaaatgcattggaaactgggaaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcctagagataggacgttcccttcggggacgctaagacaggtggtgcatggttgtcgtcagctcgtgtcgtgagatgttgggttaagtcccgcaacgagcgcaacccttattatcagttgccagcatttagttgggcactctggtgagactgccggtgacaaaccggaggaaggtggggatgacgtcaaatcatcatgccccttatgacctgggctacacacgtgctacaatggctagtacaacgagttgcgagaccgcgaggtcaagctaatctctaaaagctagtctcagttcggattgtaggctgcaactcgcctacatgaagttggaatcgctagtaatcgcggatcagcacgccgcggtgaatacgttcccgggccttgtacacaccgcccgtcacaccatgagagtttgtaacacccgaagccggtggagtaacccgtaagggagctagccgtctaaggtgggacagatgattagggtgaagtcgtaacaaggtagccgtaggagaacctgcggctggatcacctcctttctaaggaa

SEQ ID NO: 4666 - DNA, 1584 bp, Lactobacillus diolivorans
  ref <308>: DATABASE ACCESSION NUMBER: NCBI ACCESSION: NZ_AZEY01000081.1
  ref <309>: DATABASE ENTRY DATE: 2019-04-01
  ref <313>: RELEVANT RESIDUES IN SEQ ID NO: (1)..(1584)
ataagatgagagtttgatcctggctcaggacgaacgctggcggcgtgcctaatacatgcaagtcgaacgcgtcttggtcaataattttaggtgcttgcacttgactgatttgacattaagacgagtggcgaactggtgagtaacacgtgggtaacctgcccttgaagtagaggataacacttggaaacaggtgctaatactgcataacaacgaaaaccgcctggttttcgtttgaaagatggcttcggctatcgctttaggatggacccgcggcgtattagctagttggtgaggtaacggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacgggtgtcagagtaactgttgacatcgtgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcgggggccagccgtctaaggtgggacagatgattagggtgaagtcgtaacaaggtagccgtaggagaacctgcggctggatcacctcctttctaaggaa

SEQ ID NO: 4667 - DNA, 844 bp, Lactobacillus equi
  ref <308>: DATABASE ACCESSION NUMBER: NCBI ACCESSION: NZ_AZFH01000040.1
  ref <309>: DATABASE ENTRY DATE: 2019-04-01
  ref <313>: RELEVANT RESIDUES IN SEQ ID NO: (1)..(844)
agaaccgcatggttctgggatgaaaggtggcgtaagctatcgctttaggatggacccgcggcgtattagcttgttggtggggtaatggcctaccaaggcgatgatacgtagccgaactgagaggttgatcggccacattgggactgagacacggcccaaactcctacgggaggcagcagtagggaatcttccacaatggacgcaagtctgatggagcaacgccgcgtgaatgaagaaggccttcgggtcgtaaaattctgttgttagagaagaacatgcaggagagtaactgttcttgtattgacggtatctaaccagaaagccacggctaactacgtgccagcagccgcggtaatacgtaggtggcaagcgttgtccggatttattgggcgtaaagggaacgcaggcggttttttaagtctgatgtgaaagccttcggctcaaccgaagaattgcattggaaactggaagacttgagtgcagaagaggagagtggaactccatgtgtagcggtggaatgcgtagatatatggaagaacaccagtggcgaaagcggctctctggtctgtaactgacgctgaggttcgaaagcgtgggtagcaaacaggattagataccctggtagtccacgccgtaaacgatgaatactaagtgttggagggtttccgcccttcagtgctgcagctaacgcaataagtattccgcctggggagtacggccgcaaggctgaaactcaaaggaattgacgggggcccgcacaagcggtggagcatgtggtttaattcgaagcaacgcgaagaaccttaccaggtcttgacatcttttgaccatctgagagatcaga

SEQ ID NO: 4668 - DNA, 734 bp, Lactobacillus equicursoris
  misc_feature (528)..(528): n is a, c, g, or t
  ref <308>: DATABASE ACCESSION NUMBER: NCBI ACCESSION: NZ_AZDU01000118.1
  ref <309>: DATABASE ENTRY DATE: 2019-04-01
  ref <313>: RELEVANT RESIDUES IN SEQ ID NO: (1)..(734)
aatcgagagtttgatcctggctcaggacgaacgctggcggcgtgcctaatacatgcaagtcgaacgcactctcgttagatagaagaagcttgcttctgattgataacatttgagtgagtggcggacgggtgagtaacacgtgggtaacctgccctaaagtgggggataacatttggaaacagatgctaataccgcataaaacctagcaccgcatggtgcaaggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaacgtatttgatagtaactgatcaggtagtgacggtatccaaccagaaagcnagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtgg

SEQ ID NO: 4669 - DNA, 592 bp, Lactobacillus equigenerosi
  ref <308>: DATABASE ACCESSION NUMBER: NCBI ACCESSION: NZ_BCMX01000083.1
  ref <309>: DATABASE ENTRY DATE: 2019-04-01
  ref <313>: RELEVANT RESIDUES IN SEQ ID NO: (1)..(592)
tccatgtgtagcggtggaatgcgtagatatatggaagaacaccagtggcgaaggcggctgcctggtctgtaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccctagagatagggcgtttccttcgggaacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagcagcgaactcgcga

SEQ ID NO: 4670 - DNA, 1575 bp, Lactobacillus fabifermentans
  ref <308>: DATABASE ACCESSION NUMBER: NCBI ACCESSION: NZ_KK036466.1
  ref <309>: DATABASE ENTRY DATE: 2019-04-01
  ref <313>: RELEVANT RESIDUES IN SEQ ID NO: (1)..(1575)
ttaatttgagagtttgatcctggctcaggacgaacgctggcggcgtgcctaatacatgcaagtcgaacgaactctggtattgattggtacttgtatcatgatttacatttgagtgagtggcgaactggtgagtaacacgtgggaaacttgcccagaagcgggggataacacctggaaacagatgctaataccgcataacaacttggaccgcatggtccgagtttgaaagatggtttcggctatcacttctggatagtcccgcggcgcattagctagatggtgaggtaacggctcaccatggcaatgatgcgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttcggggaccagccgcctaaggtgggacagatgattagggtgaagtcgtaacaaggtagccgtaggagaacctgcggctggatcacctcctttctaaggaa

SEQ ID NO: 4671 - DNA, 1574 bp, Lactobacillus farciminis
  ref <308>: DATABASE ACCESSION NUMBER: NCBI ACCESSION: NZ_CP017702.1
  ref <309>: DATABASE ENTRY DATE: 2019-04-01
  ref <313>: RELEVANT RESIDUES IN SEQ ID NO: (1)..(1574)
taatatgagagtttgatcctggctcaggacgaacgctggcggcatgcctaatacatgcaagtcgaacgaaccatcctgaagattgaagcttgcttcatgattcagaccttggtgagtggcggacgggtgagtaacacgtgggtaacctgcccaaaagtgggggataacatttggaaacaagtgctaataccgcataacaactactttcacatgatcgtagcttgaaagatggctctgctatcgcttttggatggacccgcggcgtattagctagttggtgaggtaatagctcaccaaggcaatgatacgtagccgacctgagagggtaatcggccacattgggactgagacacggcccaaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgacaaactaagagattagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgcaggctgcaactcgcctgcatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgcggctggatcacctcctttctaagga

SEQ ID NO: 4672 - DNA, 1583 bp, Lactobacillus farraginis
  ref <308>: DATABASE ACCESSION NUMBER: NCBI ACCESSION: NZ_AZFY01000069.1
  ref <309>: DATABASE ENTRY DATE: 2019-04-01
  ref <313>: RELEVANT RESIDUES IN SEQ ID NO: (1)..(1583)
ttaagatgagagtttgatcctggctcaggacgaacgctggcggcgtgcctaatacatgcaagtcgaacgcgtcccggttgatgaagttgagtgcttgcacttgattgattcaacttggtgacgagtggcgaactggtgagtaacacgtgggtaacctgccccgaagcgggggataacatttggaaacaggtgctaataccgcataacaaccaaaaccacctggttttggtttgaaagacggcttcggctgtcactttgggatggacccgcggcgtattagctagttggtgaggtaacggctcaccaaggcgatgatacgtagccgacctgagagggtaatcggccacattgggactgagacacggcccaaactcctacgggaggcagcagtagggaatcttccacaatggacgcaagtctgatggagcaacgccgcgtgagtgatgaagggtttcggctcgtaaaactctgttgttggagaagaacgggtgtcagagtaactgttgacatcgtgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgctaacctaagagattaggcgttcccttcggggacggaatgacaggtggtgcatggttgtcgtcagctcgtgtcgtgagatgttgggttaagtcccgcaacgagcgcaacccttattgtcagttgccagcattcagttgggcactctggcgagactgccggtgacaaaccggaggaaggtggggatgacgtcaaatcatcatgccccttatgacctgggctacacacgtgctacaatggacggtacaacgagtcgcgaaaccgcgaggtcaagctaatctctgaaagccgttctcagttcggattgcaggctgcaactcgcctgcatgaagttggaatcgctagtaatcgtggatcagcatgccacggtgaatacgttcccgggccttgtacacaccgcccgtcacaccatgagagtttgtaacacccaaagccggtgaggtaaccttcgggggccagccgtctaaggtgggacagatgattagggtgaagtcgtaacaaggtagccgtaggagaacctgcggctggatcacctcctttctaaggaa

SEQ ID NO: 4673 - DNA, 1464 bp, Lactobacillus fermentum
  ref <308>: DATABASE ACCESSION NUMBER: NCBI ACCESSION: NZ_OKQY01000093.1
  ref <309>: DATABASE ENTRY DATE: 2019-04-01
  ref <313>: RELEVANT RESIDUES IN SEQ ID NO: (1)..(1464)
cgagtggcggacgggtgagtaacacgtaggtaacctgcccagaagcgggggacaacatttggaaacagatgctaataccgcataacagcgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttctaaggaa

SEQ ID NO: 4674 - DNA, 1580 bp, Lactobacillus floricola
  ref <308>: DATABASE ACCESSION NUMBER: NCBI ACCESSION: NZ_AYZL01000003.1
  ref <309>: DATABASE ENTRY DATE: 2019-04-01
  ref <313>: RELEVANT RESIDUES IN SEQ ID NO: (1)..(1580)
taaaatgagagtttgatcctggctcaggacgaacgctggcggcgtgcctaatacatgcaagtcgaacgagtttgctcttatgaaggtagtgcttgcactacttgattaagaatccaaacgagtggcggacgggtgagtaacacgtgggtaacctaccctaaagcgggggataacatttggaaacagatgctaataccgcataacaataagaatcgaatgtttcttatttaaaagatggtttcggctatcactttaggatggacctgcggcgtattagctagttggtaaggtaatggcttaccaaggcgatgatacgtagccgacctgagagggtgatcggccacattgggactgagacacggcccaaactcctacgggaggcagcagtagggaatcttccacaatggacgaaagtctgatggagcaacgccgcgtgagtgatgaagggtttcggctcgtaaaactctgttgttagagaagaaagatagtaagagtaactgtttattatttgacggtaactaaccagaaagccacggctaactacgtgccagcagccgcggtaatacgtaggtggcaagcgttgtccggatttattgggcgtaaagcgagcgcaggcggctaattaagtctgatgtgaaagccttcggcttaaccggagaagtgcattagaaactgattagcttgagtgcagaagaggagagtggaactccatgtgtagcggtgaaatgcgtagatatatggaagaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgcaacgcgaagaaccttaccaggtcttgacatcttttgaccacctaagagattaggttttcccttcggggacaaaatgacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggatgacgtcaaatcatcatgccccttatgacctgggctacacacgtgctacaatggatggtacaacgagcagcgataccgcgaggtttagctaatctcctaaaaccatcctcagttcggattgcaggctgcaactcgcctgcatgaagctggaatcgctagtaatcgcagatcagcatgctgcggtgaatacgttcccgggccttgtacacaccgcccgtcacaccatgagagtttgtaacacccgaagccggtgaggtaaccttttaggagccaaccgtctaaggtgggacagatgattagggtgaagtcgtaacaaggtagccgtaggagaacctgcggctggatcacctcctttctaagga

SEQ ID NO: 4675 - DNA, 1582 bp, Lactobacillus florum
  ref <308>: DATABASE ACCESSION NUMBER: NCBI ACCESSION: NZ_AYZI01000021.1
  ref <309>: DATABASE ENTRY DATE: 2019-04-01
  ref <313>: RELEVANT RESIDUES IN SEQ ID NO: (1)..(1582)
taaaatgagagtttgatcctggctcaggacgaacgttggcggcgtgcctaatacatgcaagtcgaacgaggctgcccagttgctagtcggtgcttgcactgacgaacaattggatccagccgagtggcgaactggtgagtaacacgtgggtaacctgcccagcagaaggggataacacctggaaacagatgctaataccgtataaacctgaaaaccgcctggttttcagctaaaagatggtgtacgctatcgctgctggatggacccgcggcgtattagctagttggcgagataatagctcaccaaggcgatgatacgtagcagacctgagagggtaatctgccacaatgggactgagacacggcccatactcctacgggaggcagcagtagggaatcttccacaatggacgaaagtctgatggagcaacgccgcgtgagtgaagaagggtttcggctcgtaaaactctgttgttagagaagaacgatcgtaagagtaactgcttacggtgtgacggtatctaaccagaaagtcacggctaactacgtgccagcagccgcggtaatacgtaggtggcaaacgttgtccggatttattgggcgtaaagcgagcgcaggcggttttctaagtctgatgtgaaagccttcggcttaaccgaagaagtgcatcggaaactggggaacttgagggcaggaaaggatagtggaacttcatgtgtagcggtgaaatgcgtagatatatgaaggaacaccagtggcgaaggcggctatctggtctgcatctgacgctgaggctcgaaagcatgggtagcaaacaggattagataccctggtagtccatgccgtaaacgatgaatgctaggtgttgggaggtttccgcctctcagtgccggagctaacgcattaagcattccgcctggggagtacgaccgcaaggttgaaactcaaaggaattgacggggacccgcacaagcggtggagcatgtggtttaattcgatgctacgcgaagaaccttaccaggtcttgacatcttctgttagcctaagagattaggtgtccccttcgggggcagaatgacaggtggtgcatggttgtcgtcagctcgtgtcgtgagatgttgggttaagtcccgcaacgagcgcaacccttgtttttagttgccagcatttagttgggcactctaaagagactgccggtgataaaccggaggaaggtggggacgacgtcaaatcatcatgccccttatgacctgggctacacacgtgctacaatggacggtacaacgagttgcgaaaccgcgaggtcaagctaatctcttaaagccgttctcagttcggattgcaggctgcaactcgcctgcatgaagttggaatcgctagtaatcgtggatcagcatgccacggtgaatacgttcccgggtcttgtacacaccgcccgtcacaccatgagagtttgtaacacccaaagtcggttggataaccttcgggagtccgccgcctaaggtgggacagatgattagggtgaagtcgtaacaaggtagccgtaggagaacctgcggctggatcacctcctttctaaggaa

SEQ ID NO: 4676 - DNA, 999 bp, Lactobacillus formosensis
  ref <308>: DATABASE ACCESSION NUMBER: NCBI ACCESSION: NZ_QWDI01000014.1
  ref <309>: DATABASE ENTRY DATE: 2019-04-01
  ref <313>: RELEVANT RESIDUES IN SEQ ID NO: (1)..(999)
gtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccatgacaaactaagagattagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgcaggctgcaactcgcctgcatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgcggctggatcacctcctttctaagga

SEQ ID NO: 4677 - DNA, 1584 bp, Lactobacillus fructivorans
  ref <308>: DATABASE ACCESSION NUMBER: NCBI ACCESSION: NZ_QSLO01000005.1
  ref <309>: DATABASE ENTRY DATE: 2019-04-01
  ref <313>: RELEVANT RESIDUES IN SEQ ID NO: (1)..(1584)
taaaatgagagtttgatcctggctcaggacgaacgctggcggcatgcctaatacatgcaagtcgaacgagctgcgcctaatgatagttgatgcttgcattagcttgacttaagttagcagcgagtggcgaactggtgagcaacacgtggataacctgcccagaagaaggggataacacctggaaacagatgctaataccgtataacaacgaaaaccacatggttttcgtttgaaagatggcctttgtgctatcgcttttggatggatccgcggcgcattagctagttggtgagataaaggctcaccaaggcaatgatgcgtagccgacctgagagggtaatcggccacattgggactgagacacggcccagactcctacgggaggcagcagtagggaatcttccacaatggacaaaagtctgatggagcaatgccgcgtgagtgaagaagggtttcggctcgtaaaactctgttgttagagaagaacgggcgtgagagtaattgctcacgtcgcgacggtatctaaccagaaagtcacggctaactacgtgccagcagccgcggtaatacgtaggtggcaagcgttgtccggatttattgggcgtaaagcgagcgcaggcggtcttctaagtctgatgtgaaagccttcggcttaaccggagaagtgcatcggaaactgggaaacttgagtgcagaagaggacagtggaactccatgtgtagcggtgaaatgcgtagatatatggaggaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacggggacccgcacaagcggtggagcatgtggtttaattcgatgctacgcgaagaaccttaccaggtcttgacatcttctgttaacctaagagattaggtgtccccttcgggggcagaatgacaggtggtgcatggttgtcgtcagctcgtgtcgtgagatgttgggttaagtcccgcaacgagcgcaacccttgtcattagttgccagcattaagttgggcactctagtgagactgccggtgacaaaccggaggaaggtggggatgacgtcaaatcatcatgccccttatgacctgggctacacacgtgctacaatggacggtacaacgagttgcgaaaccgcgaggtcaagctaatctcttaaagccgttctcagttcggattgcaggctgcaactcgcctgcatgaagttggaatcgctagtaatcgtggatcagcatgccacggtgaatacgttcccgggtcttgtacacaccgcccgtcacaccatgagagtttgtaacacccaaagtcggttaggtaaccttttggagcctgccgcctaaggtgggacagatgattagggtgaagtcgtaacaaggtagccgtaggagaacctgcggctggatcacctcctttctaaggaa

SEQ ID NO: 4678 - DNA, 1584 bp, Lactobacillus frumenti
  ref <308>: DATABASE ACCESSION NUMBER: NCBI ACCESSION: NZ_AZER01000001.1
  ref <309>: DATABASE ENTRY DATE: 2019-04-01
  ref <313>: RELEVANT RESIDUES IN SEQ ID NO: (1)..(1584)
tttatatgagagtttgatcctggctcaggatgaacgccggcggtgtgcctaatacatgcaagtcgagcgcactggcccaactgatatgacgtgcttgcactgatttgacgatggattaccagtgagcggcggacgggtgagtaacacgtgggcaacctgccctggagcgggggataacatctggaaacaggtgctaataccgcatgactactaaaaccacatggttttagtataaaagaaggcttcggctttcactctaggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttgaagaagaacgtgcgtgagagtaactgttcacgcagtgacggtattcaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctcagagatgaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagttgcgaactcgcgagggcaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatggaagtttgcaatgcccaaagtcggtggcctaaccatttggagggaaccgcctaaggcagggcagatgactggggtgaagtcgtaacaaggtagccgtaggagaacctgcggctggatcacctcctttctaaggaa

SEQ ID NO: 4679 - DNA, 1580 bp, Lactobacillus fuchuensis
  ref <308>: DATABASE ACCESSION NUMBER: NCBI ACCESSION: NZ_LT984417.1
  ref <309>: DATABASE ENTRY DATE: 2019-04-01
  ref <313>: RELEVANT RESIDUES IN SEQ ID NO: (1)..(1580)
ttaattgagagtttgatcctggctcaggacgaacgctggcggcgtgcctaatacatgcaagtcgaacgcactctggaactgattgaagaagcttgcttctgattgaagctcatttgagtgagtggcggacgggtgagtaacacgtgggtaacctgccctaaagtgggggataacatttggaaacagatgctaataccgcataaaacctagcaccgcatggtgcaaggttgaaagatggtttcggctatcactttaggatggacccgcggtgcattagttagttggtgaggtaaaggcccaccaagactgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaatgtatctgatagtaactgatcaggtagtgacggtatccaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacatcttctgaaaatcttagagataagacgttcccttcggggacagaatgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagtcgcaaaaccgcgaggttaagctaatctcttaaaaccattctcagttcggattgtaggctgcaactcgcctacatgaagccggaatcgctagtaatcgcggatcagcatgccgcggtgaatacgttcccgggccttgtacacaccgcccgtcacaccatgagagtttgtaacacccaaagccggtgaggtaaccttcgggagccagccgtctaaggtgggacagatgattagggtgaagtcgtaacaaggtagccgtaggagaacctgcggctggatcacctcctttctaaggaa

SEQ ID NO: 4680 - DNA, 1582 bp, Lactobacillus furfuricola
  ref <308>: DATABASE ACCESSION NUMBER: NCBI ACCESSION: NZ_RHNT01000083.1
  ref <309>: DATABASE ENTRY DATE: 2019-04-01
  ref <313>: RELEVANT RESIDUES IN SEQ ID NO: (1)..(1582)
aaaatatgagagtttgatcctggctcaggatgaacgctggcggcgtgcctaatacatgcaagtcgagcgaactctggtaactgatttttgatgcttgcatcaaaatgaagatacatttgagtgagcggcggatgggtgagtaacacgtgggtaacctgccctaaagtgggggataacatctggaaacaggtgctaataccgcataacaacaatttccacatggtcattgtttgaaagatggttctgctatcgctttaggatggacccgcggcgtattagctagttggtgaggtaacggctcaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttatccggatttattgggcgtaaagtgagtgcaggcggtttataaggtctgatgtgaaagccctcggctcaaccgaggaagtgcatcggaaaccggtaaacttgagtgcagaagaggagagtggaactccatgtgtagcggtggaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccatgaaagtctaagagattagaggttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaagga

SEQ ID NO: 4681 - DNA, 1574 bp, Lactobacillus futsaii
  ref <308>: DATABASE ACCESSION NUMBER: NCBI ACCESSION: NZ_AZDO01000040.1
  ref <309>: DATABASE ENTRY DATE: 2019-04-01
  ref <313>: RELEVANT RESIDUES IN SEQ ID NO: (1)..(1574)
taatatgagagtttgatcctggctcaggacgaacgctggcggcatgcctaatacatgcaagtcgaacgaaccaaactgttgattaaagcttgctttatgattcagaccttggtgagtggcggacgggtgagtaacacgtgggtaacctgcccaaaagtgggggataacatttggaaacaagtgctaataccgcataacaactactttcacatgatcgtagcttgaaagatggctctgctatcacttttggatggacccgcggcgtattagctagttggtgaggtaatagctcaccaaggcaatgatacgtagccgacctgagagggtaatcggccacattgggactgagacacggcccaaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttcacgtactgacggtattcaaccagaaagccacggctaactacgtgccagcagccgcggtaatacgtaggtggcaagcgttgtccggatttattgggcgtaaagagaatgtaggcggtctattaagtttgaagtgaaagccctcggctcaaccgaggaagtgcttcgaaaactggtagacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccatgaaaagcttagagataagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgcaggctgcaactcgcctgcatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgcggctggatcacctcctttctaagga

SEQ ID NO: 4682 - DNA, 1583 bp, Lactobacillus gastricus
  ref <308>: DATABASE ACCESSION NUMBER: NCBI ACCESSION: NZ_AZFN01000048.1
  ref <309>: DATABASE ENTRY DATE: 2019-04-01
  ref <313>: RELEVANT RESIDUES IN SEQ ID NO: (1)..(1583)
tttatatgagagtttgatcctggctcaggatgaacgccggcggtgtgcctaatacatgcaagtcgaacgcgttggcccaactgattgacgatgcttgcatcagattgacgttggatttctaacgagtggcggacgggtgagtaacacgtaggtaacctgcccagaagcgggggataacatctggaaacaggtgctaataccgcataacaattcaaatcgcatggtttgaatttaaaagatggctctgctatcacttctggatggacctgcggcgcattagcttgttggtagggtaatggcctaccaaggcagtgatgcgtagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttgaagaagaacgtgcatgagagtaactgttcatgcagtgacggtattcaaccagaaagtcacggctaactacgtgccagcagccgcggtaatacgtaggtggcaagcgttatccggatttattgggcgtaaagagagtgcaggcggtttcttaagtctgatgtgaaagccttcggctcaaccgaagaagtgcatcggaaactgggagacttgagtacagaagagggcagtggaactccatgtgtagcggtggaatgcgtagatatatggaagaacaccagtggcgaaggcggctgcctggtctgtaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggattgcaggctgcaactcgcctgcatgaagtcggaatcgctagtaatcgcggatcagcatgccgcggtgaatacgttcccgggccttgtacacaccgcccgtcacaccatgagagtttgtaacacccaaagtcggtggggtaaccatttggagccagccgcctaaggtgggacagatgattagggtgaagtcgtaacaaggtagccgtaggagaacctgcggctggatcacctcctttctaaggaa

SEQ ID NO: 4683 - DNA, 1567 bp, Lactobacillus ghanensis
  ref <308>: DATABASE ACCESSION NUMBER: NCBI ACCESSION: NZ_AZGB01000014.1
  ref <309>: DATABASE ENTRY DATE: 2019-04-01
  ref <313>: RELEVANT RESIDUES IN SEQ ID NO: (1)..(1567)
taaaatgagagtttgatcctggctcaggacgaacgctggcggcgtgcctaatacatgcaagtcgaacgaagttgttttaactggtgcttgcaccgacttaaacaactgagtggcgaacgggtgagtaacacgtgggtaacctgccccaaagtgggggataacatttggaaacagatgctaataccgcataaccacagaaacctcatggtttctgtgtcaaagatggtttcggctatcactttgggatggacccgcggcgtattagctagttggtaaggtaacggcttaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgtcagagaagaacgtgtgcgagagtaactgttcgtgcagtgacggtatctgaccagaaagccacggctaactacgtgccagcagccgcggtaatacgtaggtggcaagcgttgtccggatttattgggcgtaaagggaacgcaggcggttttttaagtctgatgtgaaagccttcggcttaaccgaagtcgtgcattggaaactggagaacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgctgtaaacgatgaatgctaagtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttctgcaagcctgagagatcaggtgttcccttcggggacagaatgacaggtggtgcatggttgtcgtcagctcgtgtcgtgagatgttgggttaagtcccgcaacgagcgcaacccttattgccagttgccagcattcagttgggcactctgacaagactgccggtgacaaaccggaggaaggtggggatgacgtcaaatcatcatgccccttatgacctgggctacacacgtgctacaatggacgatacaacgagttgctagaccgcgaggttaagctaatctcttaaagtcgttctcagttcggattgcaggctgcaactcgcctgcatgaagtcggaatcgctagtaatcgcggatcagcatgccgcggtgaatacgttcccgggccttgtacacaccgcccgtcacaccatgagagtttgtaacacccaaagccggtggggtaaccattaggaaccagccgtctaaggtgggacagatgattggggtgaagtcgtaacaaggtagccgtaggagaacctgcggctggatcacctcctttctaagga

SEQ ID NO: 4684 - DNA, 1110 bp, Lactobacillus gigeriorum
  ref <308>: DATABASE ACCESSION NUMBER: NCBI ACCESSION: NZ_AYZO01000082.1
  ref <309>: DATABASE ENTRY DATE: 2019-04-01
  ref <313>: RELEVANT RESIDUES IN SEQ ID NO: (1)..(1110)
aaaggcctaccaaggcgatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaggatagagagagtaactgatctttatttgacggtaatcaaccagaaagtcacggctaactacgtgccagcagccgcggtaatacgtaggtggcaagcgttgtccggatttattgggcgtaaagcgagcgcaggcggaaagataagtctgatgtgaaagccctcggctcaaccggggaactgcatcggaaactgtctttcttgagtgcagaagaggagagtggaactccatgtgtagcggtggaatgcgtagatatatggaagaacaccagtggcgaaagcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgcaatcccaagagattgggagttcccttcggggacgctaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggacgacgtcaagtcatcatgccccttatgacctgggctacacacgtgctacaatgggcagtacaacgagcagcgagcctgcgaaggcaagcaaatctctgaaagctgttctcagttcggactgcagtctgcaactcgactgcacgaagctggaatcgctagtaatcgcggatcagcacgccgcgg

SEQ ID NO: 4685 - DNA, 1582 bp, Lactobacillus ginsenosidimutans
  ref <308>: DATABASE ACCESSION NUMBER: NCBI ACCESSION: NZ_CP012034.1
  ref <309>: DATABASE ENTRY DATE: 2019-04-01
  ref <313>: RELEVANT RESIDUES IN SEQ ID NO: (1)..(1582)
aaaatatgagagtttgatcctggctcaggatgaacgctggcggcgtgcctaatacatgcaagtcgagcgaactctggtaaatgaatgaaggtgcttgcacctgattgattttacatttgagtgagcggcggatgggtgagtaacacgtgggtaacctgccctaaagtgggggataacatctggaaacaggtgctaataccgcataacaacaatttccacatggttattgtttgaaagatggttctgctatcgctttaggatggacccgcggcgtattagttagttggtgaggtaacggctcaccaagacgatgatacgtagccgacctgagagggtaatcggtcacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttatccggatttattgggcgtaaagcgagtgcaggcggtttattaggtctgatgtgaaagccctcggctcaaccgaggaagtgcatcggaaaccggtaaacttgagtgcagaagaggagagtggaactccatgtgtagcggtggaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaagga

SEQ ID NO: 4686 - DNA, 1473 bp, Lactobacillus gorillae
  ref <308>: DATABASE ACCESSION NUMBER: NCBI ACCESSION: NZ_BCAH01000055.1
  ref <309>: DATABASE ENTRY DATE: 2019-04-01
  ref <313>: RELEVANT RESIDUES IN SEQ ID NO: (1)..(1473)
gattttggtcgccaacgagtggcggacgggtgagtaacacgtaggcaacctgcccagaagcgggggacaacatttggaaacagatgctaataccgcataacaacgttgttcgcatgaacaacgtttcaaagatggcctctggctatcacttctggatggacctgcggtgcattagcttgttggtggggtaatggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacatgcgtgagagtaactgttcacgcattgacggtatttaaccagaaagtcacggctaactacgtgccagcagccgcggtaatacgtaggtggcaagcgttatccggatttattgggcgtaaagagagtgcaggcggtttactaagtctgatgtgaaagccttcggcttaaccggagaagggcatcggaaactggctaacttgagtgcagaagagggtagtggaactccatgtgtagcggtggaatgcgtagatatatggaagaacaccagtggcgaaggcggctacctggtctgtaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctctgaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccatttggagccagccgcctaaggtgggacagatgattagggtgaagtcgtaacaaggtagccgtaggagaacctgcggctggatcacctcctttcta

SEQ ID NO: 4687 - DNA, 1578 bp, Lactobacillus graminis
  ref <308>: DATABASE ACCESSION NUMBER: NCBI ACCESSION: NZ_AYZB01000012.1
  ref <309>: DATABASE ENTRY DATE: 2019-04-01
  ref <313>: RELEVANT RESIDUES IN SEQ ID NO: (1)..(1578)
aatcgagagtttgatcctggctcaggacgaacgctggcggcgtgcctaatacatgcaagtcgaacgcactctcgttagatagaagaagcttgcttctgattgataacatttgagtgagtggcggacgggtgagtaacacgtgggtaacctgccctaaagtgggggataacatttggaaacagatgctaataccgcataaaacctagcaccgcatggtgcaaggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaacgtatttgatagtaactgatcaggtagtgacggtatccaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggatggtacaacgagttgcgagaccgcgaggtttagctaatctcttaaaaccattctcagttcggattgtaggctgcaactcgcctacatgaagccggaatcgctagtaatcgcggatcagcatgccgcggtgaatacgttcccgggccttgtacacaccgcccgtcacaccatgagagtttgtaacacccaaagccggtgaggtaacctttcggggagccagccgtctaaggtgggacagatgattagggtgaagtcgtaacaaggtagccgtaggagaacctgcggctggatcacctcctttctaaggaa

SEQ ID NO: 4688 - DNA, 1281 bp, Lactobacillus hammesii
  ref <308>: DATABASE ACCESSION NUMBER: NCBI ACCESSION: NZ_AZFS01000017.1
  ref <309>: DATABASE ENTRY DATE: 2019-04-01
  ref <313>: RELEVANT RESIDUES IN SEQ ID NO: (1)..(1281)
ataagatgagagtttgatcctggctcaggacgaacgctggcggcatgcctaatacatgcaagtcgaacgagcttccgttgaatgacgtgcttgcactgatttcaacattgaagcgagtggcgaactggtgagtaacacgtgggtaacttgcccagaagcaggggataacacttggaaacaggtgctaataccgtataacaacagaaaccgcatggtttctgtttgaaaggtggtttcggctatcacttctggatggacccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacttctgagagtaactgttcagaagttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatcttagagataagacgttcccttcggggacagaatgacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagt

SEQ ID NO: 4689 - DNA, 1574 bp, Lactobacillus hamsteri
  ref <308>: DATABASE ACCESSION NUMBER: NCBI ACCESSION: NZ_AZGI01000007.1
  ref <309>: DATABASE ENTRY DATE: 2019-04-01
  ref <313>: RELEVANT RESIDUES IN SEQ ID NO: (1)..(1574)
ttaaaaatgagagtttgatcctggctcaggacgaacgctggcggcgtgcctaatacatgcaagtcgagcgagcagaactaacagatctacttcggtagtgacgtttcggaagcgagcggcggatgggtgagtaacacgtgggtaacctgcccttaagtctgggataccatttggaaacaggtgctaataccggataacaacattgatcgcatgatcgatgcttgaaaggcggcgtaagctgtcgctaaaggatggacccgcggtgcattagctagttggtaaggtaacggcttaccaaggcaacgatgcatagccgagttgagagactgatcggccacattgggactgagacacggcccaaactcctacgggaggcagcagtagggaatcttccacaatgggcgaaagcctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccggggaagtgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgcaattcgtagagatacgaagttcccttcggggacgctaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggacgacgtcaagtcatcatgccccttatgacctgggctacacacgtgctacaatgggcagtacaacgagaagcaaacctgcgaaggcaagcgaatctctgaaagctgttctcagttcggactgtaggctgcaactcgcctacacgaagctggaatcgctagtaatcgcggatcagcacgccgcggtgaatacgttcccgggccttgtacacaccgcccgtcacaccatggaagtctgcaatgcccaaagccggtggcctaaccttcgggaaggagccgtctaaggcagggcagatgactggggtgaagtcgtaacaaggtagccgtaggagaacctgcggctggatcacctcctttctaaggaa

SEQ ID NO: 4690 - DNA, 382 bp, Lactobacillus harbinensis
  ref <308>: DATABASE ACCESSION NUMBER: NCBI ACCESSION: NZ_LTDZ01000204.1
  ref <309>: DATABASE ENTRY DATE: 2019-04-01
  ref <313>: RELEVANT RESIDUES IN SEQ ID NO: (1)..(382)
ttaaatgagagtttgatcctggctcaggacgaacgctggcggcgtgcctaatacatgcaagtcgaacgaggtttggtcagtttgcggtggtgcttgcatcaccaattaccgatcaaaccgagtggcggacgggtgagtaacacgtgggtaacctgcccttcagcaggggataacatttggaaacagatgctaataccgtataaccacggagaccgcatggtctccgggtaaaagatggcgcaagctatcactgaaggatggacccgcggcgtattagccagttggtggggtaacggcctaccaaagcgatgatacgtagccgacctgagagggtaatcggccacattgggactgagacacggcccaaactcctacgggaggc

SEQ ID NO: 4691 - DNA, 1570 bp, Lactobacillus hayakitensis
  ref <308>: DATABASE ACCESSION NUMBER: NCBI ACCESSION: NZ_AZGD01000007.1
  ref <309>: DATABASE ENTRY DATE: 2019-04-01
  ref <313>: RELEVANT RESIDUES IN SEQ ID NO: (1)..(1570)
taaattgagagtttgatcctggctcaggatgaacgctggcggcgtgcctaatacatgcaagtcgaacgcaactttcttacaccgatgcttgcatcaccgtaagaaagttgagtggcggacgggtgagtaacacgtgggtaacctgcccagaagagggggataacacttggaaacaggtgctaataccgcatatctctaagaaccgcatggttcttagatgaaagatggttctgctatcgcttctggatggacccgcggcgcattaactagttggtggggtaacggcctaccaaggtgatgatgcgtagccgaactgagaggttgatcggccacattgggactgagacacggcccaaactcctacgggaggcagcagtagggaatcttccacaatgggcgaaagcctgatggagcaacgccgcgtgagtgaagaaggtcttcggatcgtaaagctctgttgttagagaagaacactgatgagagtaactgttcatcagttgacggtatctaaccagcaagtcacggctaactacgtgccagcagccgcggtaatacgtaggtggcaagcgttatccggatttattgggcgtaaagggaacgcaggcggttttttaagtctgatgtgaaagccttcggcttaaccggagaatagcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaggtgttggagggtttccgcccttcagtgccgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcctttgaccacttgagagatcaagctttcccttcggggacaaagtgacaggtggtgcatggctgtcgtcagctcgtgtcgtgagatgttgggttaagtcccgcaacgagcgcaacccttgttgtcagttgccagcattaagttgggcactctggcgagactgccggtgacaaaccggaggaaggtggggacgacgtcaagtcatcatgccccttatgacctgggctacacacgtgctacaatggatgatacaacgagtcgcgagaccgcgaggtttagctaatctcttaaagtcattctcagttcggattgtaggctgcaactcgcctacatgaagtcggaatcgctagtaatcgcgaatcagcatgtcgcggtgaatacgttcccgggccttgtacacaccgcccgtcacaccatgagagtttgtaacacccaaagccggtggggtaaccttttaggagctagccgtctaaggtgggacagatgattggggtgaagtcgtaacaaggtagccgtaggagaacctgcggctggatcacctcctttctaaggaa

SEQ ID NO: 4692 - DNA, 1574 bp, Lactobacillus heilongjiangensis
  ref <308>: DATABASE ACCESSION NUMBER: NCBI ACCESSION: NZ_CP012559.1
  ref <309>: DATABASE ENTRY DATE: 2019-04-01
  ref <313>: RELEVANT RESIDUES IN SEQ ID NO: (1)..(1574)
taatatgagagtttgatcctggctcaggacgaacgctggcggcatgcctaatacatgcaagtcgaacgaactttcccgatgattgaagcttgcttcatgaatcggatctaagtgagtggcggacgggtgagtaacacgtgggtaacctgcccaaaagtgggggataacatttggaaacaagtgctaataccgcataacaactactttcacatgatcgtagtttaaaagatggctctgctatcgcttttggatggacccgcggcgtattagctagttggtgaggtaaaggctcaccaaggcaatgatacgtagccgacctgagagggtaatcggccacattgggactgagacacggcccaaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcaaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgctgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaacccttcggggagctagccgtctaaggtgggacaaatgattagggtgaagtcgtaacaaggtagccgtaggagaacctgcggctggatcacctcctttctaagga

SEQ ID NO: 4693 - DNA, 1574 bp, Lactobacillus helsingborgensis
  ref <308>: DATABASE ACCESSION NUMBER: NCBI ACCESSION: NZ_CP029544.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaattttgacggaatacttcggtaggaagtcagaagcgcgagcggcggatgggtgagtaacacgtgggcaacctgccctttagcttgggataccacttggaaacaggtgctaataccaaataagcagcacgagcgcatgctcgagctgagaaaggcggctttcgagctgtcactaaaggatgggcccgcggtgcattagctagttggtaaggtaacggcttaccaaggcgatgatgcatagccgagttgagagactgaccggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacaagggtagtaactgattcttgtttgacggtaatcaaccagaaagtcacggctaactacgtgccagcagccgcggtaatacgtaggtggcaagcgttgtccggatttattgggcgtaaagcgaacgcaggcgggagaataagtcagctgtgaaagcccccagcttaactggggaagagcaactgaaactatttttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgccagtcctagagataggatgtttccttcgggaacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgagcagcgaacctgcaaaggcaagcgaatctctgaaagctaatctcagttcggattgcactctgcaactcgagtgcatgaagctggaatcgctagtaatcgcggatcagcacgccgcggtgaatacgttcccgggccttgtacacaccgcccgtcacaccatgagagtctgtaatgcccaaagccggtaggataacctgcaaaggagtcagccgtctaaggcaggacagatgattagggtgaagtcgtaacaaggtagccgtaggagaacctgcggctggatcacctcctttctaaggaa

SEQ ID NO: 4694 - DNA, 1572 bp, Lactobacillus helveticus
  ref <308>: DATABASE ACCESSION NUMBER: NCBI ACCESSION: NZ_OGTV02000160.1
  ref <309>: DATABASE ENTRY DATE: 2019-04-01
  ref <313>: RELEVANT RESIDUES IN SEQ ID NO: (1)..(1572)
caaaatgagagtttgatcctggctcaggacgaacgctggcggcgtgcctaatacatgcaagtcgagcgagcagaaccagcagatttacttcggtaatgacgctggggacgcgagcggcggatgggtgagtaacacgtggggaacctgccccatagcctgggataccacttggaaacaggtgctaataccggataagaaagcagatcgcatgatcagcttataaaaggcggcgtaagctgtcgctatgggatggccccgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaactgcatcggaaactgtttttcttgagtgcagaagaggagagtggaattccatgtgtagcggtggaatgcgtagatatatggaagaacaccagtggcgaaggcgactctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatcctaagagattaggagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgataaaccggaggaaggtggggatgacgtcaagtcatcatgccccttatgacctgggctacacacgtgctacaatggacagtacaacgagaagcgagcctgcgaaggcaagcgaatctctgaaagctgttctcagttcggactgcagtctgcaactcgactgcacgaagctggaatcgctagtaatcgcggatcagaacgccgcggtgaatacgttcccgggccttgtacacaccgcccgtcacaccatggaagtctgcaatgcccaaagccggtggcctaaccttcgggaaggagccgtctaaggcagggcagatgactggggtgaagtcgtaacaaggtagccgtaggagaacctgcggctggatcacctcctttctaaggaa

SEQ ID NO: 4695 - DNA, 1577 bp, Lactobacillus herbarum
  ref <308>: DATABASE ACCESSION NUMBER: NCBI ACCESSION: NZ_LFEE01000051.1
  ref <309>: DATABASE ENTRY DATE: 2019-04-01
  ref <313>: RELEVANT RESIDUES IN SEQ ID NO: (1)..(1577)
ttaatttgagagtttgatcctggctcaggatgaacgctggcggcgtgcctaatacatgcaagtcgaacgaactctggtaatgattggtacttgtatcatgatttacatttgagtgagtggcgaactggtgagtaacacgtgggaaacctgcccagaagtgggggataacacctggaaacagatgctaataccgcataatagcttgaaccgcatggttcgagtttgaaagatggcttcggctatcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaagctctgttgttaaagaagaacatatctgagagtaactgttcaggtattgacggtatttaaccagaaagccacggctaactacgtgccagcagccgcggtaatacgtaggtggcaagcgttatccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggtcgcaagactgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaacctttataggaactagccgcctaaggtgggacagatgattagggtgaagtcgtaacaaggtagccgtaggagaacctgcggctggatcacctcctttctaaggaa

SEQ ID NO: 4696 - DNA, 749 bp, Lactobacillus hilgardii
  ref <308>: DATABASE ACCESSION NUMBER: NCBI ACCESSION: NZ_AZDF01000099.1
  ref <309>: DATABASE ENTRY DATE: 2019-04-01
  ref <313>: RELEVANT RESIDUES IN SEQ ID NO: (1)..(749)
agtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgctaacctaagagattaggcgttcccttcggggacggaatgacaggtggtgcatggttgtcgtcagctcgtgtcgtgagatgttgggttaagtcccgcaacgagcgcaacccttattgtcagttgccagcatttagttgggcactctggcgagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcgggggccagccgtctaaggtgggacagatgattagggtgaagtcgtaacaaggtagccgtaggagaacctgcggctggatcacctcctttctaaggaa

SEQ ID NO: 4697 - DNA, 1011 bp, Lactobacillus hokkaidonensis
  ref <308>: DATABASE ACCESSION NUMBER: NCBI ACCESSION: NZ_JQCH01000062.1
  ref <309>: DATABASE ENTRY DATE: 2019-04-01
  ref <313>: RELEVANT RESIDUES IN SEQ ID NO: (1)..(1011)
gcaagcgttatccggatttattgggcgtaaagcgagcgcaggcggttttttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatctagcgccaatcccagagatgggacgttcccttcggggacgctaagacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggacggtacaacgagttgcgaactcgcgagggtaagctaatctcttaaagccgttctcagttcggactgtaggctgcaactcgcctacacgaagtcggaatcgctagtaatcgcggatcagaatgccgcggtgaatacgttcccgggccttgtacacaccgcccgtcacaccatgagagtttgtaacacccaaagtcggtggggtaaccttttattaggagccagccgcctaaggtgggatagatgattagggtgaagtcgtaacaaggtagccgtaggagaacctgcggctggatcacctcctttctaaggaa

SEQ ID NO: 4698 - DNA, 1583 bp, Lactobacillus hominis
  ref <308>: DATABASE ACCESSION NUMBER: NCBI ACCESSION: NZ_AYZP01000032.1
  ref <309>: DATABASE ENTRY DATE: 2019-04-01
  ref <313>: RELEVANT RESIDUES IN SEQ ID NO: (1)..(1583)
aaggaaaatgagagtttgatcctggctcaggacgaacgctggcggcgtgcctaatacatgcaagtcgagcgagcttgcctagatgatttcggtgcttgcaccgaatgaaactagatacaagcgagcggcggacgggtgagtaacacgtgggtaacctgcccaagagactgggataacacctggaaacagatgctaataccggataacaacatctagcgcatgctagaagtttgaaagatgggtttctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttggtggtgaagaaagatagaggtagtaactggcctttatttgacggtaatcacctagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctctgaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgagataaccattaaaggagtcagccgtctaaggtaggacagatgattagggtgaagtcgtaacaaggtagccgtaggagaacctgcggctggatcacctcctttctaaggaa

SEQ ID NO: 4699 - DNA, 963 bp, Lactobacillus homohiochii
  ref <308>: DATABASE ACCESSION NUMBER: NCBI ACCESSION: NZ_JQBN01000009.1
  ref <309>: DATABASE ENTRY DATE: 2019-04-01
  ref <313>: RELEVANT RESIDUES IN SEQ ID NO: (1)..(963)
gggcgtgagagtaactgctcacgtcgcgacggtatctaaccagaaagtcacggctaactacgtgccagcagccgcggtaatacgtaggtggcaagcgttgtccggatttattgggcgtaaagcgagcgcaggcggtcttctaagtctgatgtgaaagccttcggcttaaccggagaagtgcatcggaaactgggaaacttgagtgcagaagaggacagtggaactccatgtgtagcggtgaaatgcgtagatatatggaggaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacggggacccgcacaagcggtggagcatgtggtttaattcgatgctacgcgaagaaccttaccaggtcttgacatcttctgttaacctaagagattaggtgtccccttcgggggcagaatgacaggtggtgcatggttgtcgtcagctcgtgtcgtgagatgttgggttaagtcccgcaacgagcgcaacccttgtcattagttgccagcattaagttgggcactctagtgagactgccggtgacaaaccggaggaaggtggggatgacgtcaaatcatcatgccccttatgacctgggctacacacgtgctacaatggacggtacaacgagttgcgaaaccgcgaggtcaagctaatctcttaaagccgttctcagttcggattgcaggctgcaactcgcctgcatgaagttggaatcgctagtaatcgtggatcagcatgccacggtgaatacgttcccgggtcttgtacacaccgcccgtcacaccatga

SEQ ID NO: 4700 - DNA, 1486 bp, Lactobacillus hordei
  ref <308>: DATABASE ACCESSION NUMBER: NCBI ACCESSION: NZ_AZDX01000089.1
  ref <309>: DATABASE ENTRY DATE: 2019-04-01
  ref <313>: RELEVANT RESIDUES IN SEQ ID NO: (1)..(1486)
gaatgcttgcattcacgaaagttttgagtggcgaacgggtgagtaacacgtgggtaacctgcccagaagagggggataacacttggaaacaggtgctaataccgcataataacaaaaaccgcatggtttttgtttgaaagatggttttgctatcacttctggatggacccgcggcgtattagctagttggtaaggtaaaggcttaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtgtgtgagagtaactgctcatgcagtgacggtatctaaccagaaagccacggctaactacgtgccagcagccgcggtaatacgtaggtggcaagcgttgtccggatttattgggcgtaaagggaacgcaggcggttttttaagtctgatgtgaaagccttcggcttaaccgaagtcatgcattggaaactgaaagacttgagtgcagaagaggagagtggaactccatgtgtagcggtgaaatgcgtagatatatggaagaacaccagtggcgaaagcggctctctggtctgtaactgacgctgaggttcgaaagtgtgggtagcaaacaggattagataccctggtagtccacaccgtaaacgatgaatgctaagtgttggagggtttccgcccttcggtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttctgacaacctaagagattaggtgttcccttcggggacagaatgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgacctgggctacacacgtgctacaatggacggtacaacgagtcgcgaaaccgcgaggtttagctaatctcttaaagccgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtgaggtaaccatttatggagccagccgtctaaggtgggacagatgattggggtgaagtcgtaacaaggtagccgtaggagaacctgcggctggatcacctcctttctaagga

SEQ ID NO: 4701 - DNA, 1574 bp, Lactobacillus iners
  ref <308>: DATABASE ACCESSION NUMBER: NCBI ACCESSION: NZ_NBLE01000005.1
  ref <309>: DATABASE ENTRY DATE: 2019-04-01
  ref <313>: RELEVANT RESIDUES IN SEQ ID NO: (1)..(1574)
taaattgagagtttgatcctggctcaggacgaacgctggcggcgtgcctaatacatgcaagtcgagcgagtctgccttgaagatcggagtgcttgcactctgtgaaacaagatacaggctagcggcggacgggtgagtaacacgtgggtaacctgcccaagagatcgggataacacctggaaacagatgctaataccggataacaacagatgatgcctatcaactgtttaaaagatggttctgctatcactcttggatggacctgcggtgcattagctagttggtagggtaacggcctaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttgttggtgaagaaggacaggggtagtaactgacctttgtttgacggtaatcaattagaaagtcacggctaactacgtgccagcagccgcggtaatacgtaggtggcaagcgttgtccggatttattgggcgtaaagcgagtgcaggcggctcgataagtctgatgtgaaagccttcggctcaaccggagaattgcatcagaaactgtcgagcttgagtacagaagaggagagtggaactccatgtgtagcggtgaaatgcgtagatatatggaagaacaccggtggcgaaggcggctctctggtctgttactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccatagccagtctaagagattagatgttcccttcggggactatgagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatggacggtacaacgagaagcgaccctgtgaaggcaagcggatctctgaaagccgttctcagttcggattgcaggctgcaactcgcctgcatgaagctggaatcgctagtaatcgcaaatcagcacgttgcggtgaatacgttcccgggccttgtacacaccgcccgtcacaccatgagagtctgtaacgcccgaagccggcgggataaccgaaaggagtcagccgtctaaggcgggacagatgattagggtgaagtcgtaacaaggtagccgtaggagaacctgcggctggatcacctcctttcta

SEQ ID NO: 4702 - DNA, 1465 bp, Lactobacillus ingluviei
  ref <308>: DATABASE ACCESSION NUMBER: NCBI ACCESSION: NZ_JQBA01000066.1
  ref <309>: DATABASE ENTRY DATE: 2019-04-01
  ref <313>: RELEVANT RESIDUES IN SEQ ID NO: (1)..(1465)
tttcccaacgagtggcggacgggtgagtaacacgtaggcaacctgccccgaagcgggggacaacatttggaaacaagtgctaataccgcataacaactttgaccgcctggtcaaagcttaaaagatggtttcggctatcacttcgggatgggcctgcggcgcattagcttgttggtggggtaacggcctaccaaggcgatgatgcgtagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttgaagaagaatgtgcaagagagtaactgttcttgtattgacggtattcaaccagaaagtcacggctaactacgtgccagcagccgcggtaatacgtaggtggcaagcgttatccggatttattgggcgtaaagcgagcgcaggcggttttctaagtctgatgtgaaagccttcggcttaaccgaagaagtgcatcggaaactggatgacttgagtgcagaagagggcagtggaactccatgtgtagcggtggaatgcgtagatatatggaagaacaccagtggcgaaggcggctgcctggtctgtaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagtcgcgaactcgcgagggcaagctaatctcttaaaaccgttctcagttcggactgcagtctgcaactcgactgcacgaagtcggaatcgctagtaatcgcggatcagcatgccgcggtgaatacgttcccgggccttgtacacaccgcccgtcacaccatgggagtttgcaatgcccaaagtcggtggggtaaccttttggagccagccgcctaaggcagggcagatgactggggtgaagtcgtaacaaggtagccgtaggagaacctgcggctggatcacctcctttcta

SEQ ID NO: 4703 - DNA, 1582 bp, Lactobacillus insicii
  ref <308>: DATABASE ACCESSION NUMBER: NCBI ACCESSION: NZ_RHNU01000063.1
  ref <309>: DATABASE ENTRY DATE: 2019-04-01
  ref <313>: RELEVANT RESIDUES IN SEQ ID NO: (1)..(1582)
taatatgagagtttgatcctggctcaggacgaacgctggcggcgtgcctaatacatgcaagtcgagcgaactctggtttttgatttttggtgcttgcaccaaaatgataaaacatttgagtgagcggcggatgggtgagtaacacgtgggtaacctgccctaaagtgggggataacatttggaaacaagtgctaataccgcataacaacctttgcctcatggcaatcgtttgaaagatggttctgctatcgctttaggatggacccgcggcgtattagctagttggtgaggtaacggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttgtccggatttattgggcgtaaagagaacgtaggtggtttattaagtctgatgtgaaagccctcggctcaaccgaggaagtgcatcggaaactggtaaacttgagtgcagaagaggagagtggaactccatgtgtagcggtggaatgcgtagatatatggaagaacaccagtggcgaaggcggctctctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggacgacgtcaaatcatcatgccccttatgacctgggctacacacgtgctacaatggtcggtacaacgtgctgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaaggaa

SEQ ID NO: 4704 - DNA, 1576 bp, Lactobacillus intestinalis
  ref <308>: DATABASE ACCESSION NUMBER: NCBI ACCESSION: NZ_AZGN01000031.1
  ref <309>: DATABASE ENTRY DATE: 2019-04-01
  ref <313>: RELEVANT RESIDUES IN SEQ ID NO: (1)..(1576)
aaaaatgagagtttgatcctggctcaggacgaacgctggcggcgtgcctaatacatgcaagtcgagcgagctgaaccagcagattcacttcggtgatgacgctgggaacgcgagcggcggatgggtgagtaacacgtgggtaacctgccctaaagtctgggataccacttggaaacaggtgctaataccggataacaacaatagctgcatggctattgcttaaaaggcggcgtaagctgtcgctaaaggatggacccgcggtgcattagctagttggtaaggtaacggcttaccaaggcgacgatgcatagccgagttgagagactgatcggccacattgggactgagacacggcccaaactcctacgggaggcagcagtagggaatcttccacaatgggcgaaagcctgatggagcaacgccgcgtgagtgaagaaggttttcggatcgtaaagctctgttgttggtgaagaaggatagaggtagtaactggcccctatttgacggtaatcaaccagaaagtcacggctaactacgtgccagcagccgcggtaatacgtaggtggcaagcgttgtccggatttattgggcgtaaagcgagcgcaggcggaaagataagtctgatgtgaaagcccccggcttaaccgaggaattgcatcggaaactgtgtttcttgagtgcagaagaggagagtggaactccatgtgtagcggtggaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatcctaagagattaggagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcgagcctgcgaaggcaagcggatctcttaaagctgttctcagttcggactgcagtctgcaactcgactgcacgaagctggaatcgctagtaatcgcggatcagcacgccgcggtgaatacgttcccgggccttgtacacaccgcccgtcacaccatggaagtctgcaatgcccgaagccggtggcctaaccacttatgtggaaggagccgtctaaggcagggcagatgactggggtgaagtcgtaacaaggtagccgtaggagaacctgcggctggatcacctcctttctaaggaa

SEQ ID NO: 4705 - DNA, 1577 bp, Lactobacillus iwatensis
  ref <308>: DATABASE ACCESSION NUMBER: NCBI ACCESSION: NZ_RHNP01000082.1
  ref <309>: DATABASE ENTRY DATE: 2019-04-01
  ref <313>: RELEVANT RESIDUES IN SEQ ID NO: (1)..(1577)
ttatatgagagtttgatcctggctcaggacgaacgctggcggcgtgcctaatacatgcaagtcgaacgcacagacatcaacagaagctgcttgcagtggaagttggttgatgtgagtggcggacgggtgagtaacacgtgggtaacctacccaaaagtgggggataacatttggaaacagatgctaataccgcataatttaagtgaccacatggtcacttaatgaaagatggtttcggctatcacttttggatggacccgcggcgtattagctagttggtgggataacggcctaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttggagaagaacagggactagagtaactgttagtcctttgacggtatccaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccgaagaagtgcattagaaactgggaaacttgagtgcagaagaggagagtggaactccatgtgtagcggtgaaatgcgtagatatatggaagaacaccagtggcgaaggcggctctctggtctgtaactgacgctgaggctcgaaagtatggggagcgaacaggattagataccctggtagtccataccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatcctttgaccactgtagagatacagctttcccttcggggacaaagtgacaggtggtgcatggttgtcgtcagctcgtgtcgtgagatgttgggttaagtcccgcaacgagcgcaacccttatgactagttgccagcattaagttgggcactctagtgagactgccggtgacaaaccggaggaaggtggggatgacgtcaaatcagcatgccccttatgacctgggctacacacgtgctacaatggttggtacaacgagttgcgaacccgcgagggtaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccatgagagtttgtaacacccgaagccggtggggtaacctctttgaggagctaaccgtctaaggtgggacagatgattggggtgaagtcgtaacaaggtagccgtaggagaacctgcggctggatcacctcctttctaaggaa

SEQ ID NO: 4706 - DNA, 1571 bp, Lactobacillus jensenii
  ref <308>: DATABASE ACCESSION NUMBER: NCBI ACCESSION: NZ_PKJZ01000024.1
  ref <309>: DATABASE ENTRY DATE: 2019-04-01
  ref <313>: RELEVANT RESIDUES IN SEQ ID NO: (1)..(1571)
caaaatgagagtttgatcctggctcaggacgaacgctggcggcgtgcctaatacatgcaagtcgagcgagcttgcctatagaaattcttcggaatggacatagatacaagctagcggcggatgggtgagtaacgcgtgggtaacctgcccttaagtctgggataccatttggaaacagatgctaataccggataaaagctactttcgcatgaaagaagtttaaaaggcggcgtaagctgtcgctaaaggatggacctgcgatgcattagctagttggtaaggtaacagcttaccaaggcgatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggattgataagtctgatgtgaaagccttcggctcaaccgaagaactgcatcagaaactgtcaatcttgagtgcagaagaggagagtggaactccatgtgtagcggtggaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccacctaagagattaggttttcccttcggggacaaagagacaggtggtgcatggctgtcgtcagctcgtgtcgtgagatgttgggttaagtcccgcaacgagcgcaacccttgttaatagttgccagcattaagttgggcactctattgagactgccggtgacaaaccggaggaaggtggggatgacgtcaagtcatcatgccccttatgacctgggctacacacgtgctacaatgggcagtacaacgagaagcgaacctgtgaaggcaagcggatctcttaaagctgttctcagttcggactgtaggctgcaactcgcctacacgaagctggaatcgctagtaatcgcggatcagcacgccgcggtgaatacgttcccgggccttgtacacaccgcccgtcacaccatgagagtttgtaacacccaaagtcggtgaggtaacctttggagccagccgcctaaggtgggacagatgattagggtgaagtcgtaacaaggtagccgtaggagaacctgcggctggatcacctcctttctaaggaa

SEQ ID NO: 4707 - DNA, 1581 bp, Lactobacillus johnsonii
  ref <308>: DATABASE ACCESSION NUMBER: NCBI ACCESSION: NZ_CP032680.1
  ref <309>: DATABASE ENTRY DATE: 2019-04-01
  ref <313>: RELEVANT RESIDUES IN SEQ ID NO: (1)..(1581)
gaaaatgagagtttgatcctggctcaggacgaacgctggcggcgtgcctaatacatgcaagtcgagcgagcttgcctagatgattttagtgcttgcactaaatgaaactagatacaagcgagcggcggacgggtgagtaacacgtgggtaacctgcccaagagactgggataacacctggaaacagatgctaataccggataacaacactagacgcatgtctagagtttgaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctcttaaagccgttctcagttcggactgtaggctgcaactcgcctacacgaagctggaatcgctagtaatcgcggatcagcacgccgcggtgaatacgttcccgggccttgtacacaccgcccgtcacaccatgagaatctgtaacacccaaagccggtgggataacctttataggagtcagccgtctaaggtaggacagatgattagggtgaagtcgtaacaaggtagccgtaggagaacctgcggctggatcacctcctttctaaggaa

SEQ ID NO: 4708 - DNA, 1574 bp, Lactobacillus kalixensis
  ref <308>: DATABASE ACCESSION NUMBER: NCBI ACCESSION: NZ_AZFM01000074.1
  ref <309>: DATABASE ENTRY DATE: 2019-04-01
  ref <313>: RELEVANT RESIDUES IN SEQ ID NO: (1)..(1574)
ttaaaaatgagagtttgatcctggctcaggacgaacgctggcggcgtgcctaatacatgcaagtcgagcgaacagaagcagcagaattacttcggtaaggacgctgtggaagttagcggcggatgggtgagtaacacgtgggtaacctacccttaagactgggataccacttggaaacaggtgctaataccggataggagtatgagctgcatggcttatactttaaaggcggcgaaagctgtcactaaaggatggacccgcggtgcattagctagttggtaaggtaacggcttaccaaggcgacgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatataggtagtaactggcctatatttgacggtaatcaaccagaaagtcacggctaactacgtgccagcagccgcggtaatacgtaggtggcaagcgttgtccggatttattgggcgtaaagcgagcgcaggcggagaaataagtctgatgtgaaagcccacggctcaaccgtggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccattctaagagattagaagttcccttcggggacgctaagacaggtggtgcatggctgtcgtcagctcgtgtcgtgagatgttgggttaagtcccgcaacgagcgcaacccttgtcattagttgccagcattaagttgggcactctaatgagactgccggtgacaaaccggaggaaggtggggatgacgtcaagtcatcatgccccttatgacctgggctacacacgtgctacaatgggcagtacaacgagaagcaagccggtgacggcaagcgaatctcttaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccgtaaggaaggagccgtctaaggcagggcagatgactggggtgaagtcgtaacaaggtagccgtaggagaacctgcggctggatcacctcctttctaaggaa

SEQ ID NO: 4709 - DNA, 1574 bp, Lactobacillus kefiranofaciens
  ref <308>: DATABASE ACCESSION NUMBER: NCBI ACCESSION: NZ_FMXC01000079.1
  ref <309>: DATABASE ENTRY DATE: 2019-04-01
  ref <313>: RELEVANT RESIDUES IN SEQ ID NO: (1)..(1574)
ttcaaaatgagagtttgatcctggctcaggacgaacgctggcggcgtgcctaatacatgcaagtcgagcgagcggaaccagcagaatcacttcggtgaggacgctgggaaagcgagcggcggatgggtgagtaacacgtggggaacctgcccttaagtctgggataccacttggaaacaggtgctaataccggataagaaagcagttcgcatgaacagcttttaaaaggcggcgcaagctgtcgctaaaggatggacccgcggtgcattagctagttggtaaggtaacggcctaccaaggcagtgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggaccgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaagaataagtctgatgtgaaagccctcggcttaaccgaggaattgcatcggaaactgtttttcttgagtgcagaagaggagagtagaactccatgtgtagcggtggaatgcgtagatatatggaagaataccagtggcgaaggcggctctctggtctgcaactgacgctgaggctcgaaagcatgggtagcgaacaggattagataccctggtagtccatgccgtaaacgatgagtgctaagtgttgggaggcttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatttgtagagatacaaagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagcacaacgagcagcgagcctgcaaaggcaagcaaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaatgcccaaagccggtggcctaaccgcaaggaaggagccgtctaaggcagggcagatgactggggtgaagtcgtaacaaggtagccgtaggagaacctgcggctggatcacctcctttctaaggaa

SEQ ID NO: 4710 - DNA, 1583 bp, Lactobacillus kefiri
  ref <308>: DATABASE ACCESSION NUMBER: NCBI ACCESSION: NZ_QFFL01000001.1
  ref <309>: DATABASE ENTRY DATE: 2019-04-01
  ref <313>: RELEVANT RESIDUES IN SEQ ID NO: (1)..(1583)
ttaagatgagagtttgatcctggctcaggacgaacgctggcggcgtgcctaatacatgcaagtcgaacgcgtttccgttattgattttaggtgcttgcatttgaatgatttaacacgaaacgagtggcgaactggtgagtaacacgtgggtaacctgcccttgaagtaggggataacacttggaaacaggtgctaataccgtataacaaccaaaaccacatggttttggtttaaaagatggcttcggctatcactttaggatggacccgcggcgtattagcttgttggtaaggtaatggcctaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtcagagtaactgttgacatcttgacggtatccaaccagaaagccacggctaactacgtgccagcagccgcggtaatacgtaggtggcaagcgttgtccggatttattgggcgtaaagcgagcgcaggcggtttcttaggtctgatgtgaaagccttcggcttaaccggagaagtgcatcggaaaccaggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgcaggctgcaactcgcctgcatgaagttggaatcgctagtaatcgtggatcagcatgccacggtgaatacgttcccgggccttgtacacaccgcccgtcacaccatgagagtttgtaacacccaaagccggtgaggtaaccttcggggaccagccgtctaaggtgggacagatgattagggtgaagtcgtaacaaggtagccgtaggagaacctgcggctggatcacctcctttctaaggaa

SEQ ID NO: 4711 - DNA, 1373 bp, Lactobacillus kimbladii
  ref <308>: DATABASE ACCESSION NUMBER: NCBI ACCESSION: NZ_KQ034011.1
  ref <309>: DATABASE ENTRY DATE: 2019-04-01
  ref <313>: RELEVANT RESIDUES IN SEQ ID NO: (1)..(1373)
gagcgcatgctcaagctgtaaaaggcggctttaagctgtcactaaaggatgggcccgcggtgcattagctagttggcaaggtaacggcctaccaaggcgatgatgcatagccgagttgagagactgaacggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacagggatagcaactgattcttgtttgacggtaatcaaccagaaagtcacggctaactacgtgccagcagccgcggtaatacgtaggtggcaagcgttgtccggatttattgggcgtaaagcgaacgcaggcgggagaataagtcagctgtgaaagccctcagcttaactggggaactgcagctgaaactatttttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgccagtcctagagataggatgtttccttcgggaacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgagcagcgaacctgcaaaggcaagcgaatctctgaaagctaatctcagttcggattgcactctgcaactcgagtgcatgaagctggaatcgctagtaatcgcggatcagcacgccgcggtgaatacgttcccgggccttgtacacaccgcccgtcacaccatgagagtctgtaatgcccaaagccggtaggataacctgcaaaggagtcagccgtctaaggcaggacagatgattagggtgaagtcgtaacaaggtagccgtaggagaacctgcggctggatcacctcctttctaaggaa

SEQ ID NO: 4712 - DNA, 1480 bp, Lactobacillus kimchicus
  ref <308>: DATABASE ACCESSION NUMBER: NCBI ACCESSION: NZ_AZCX01000019.1
  ref <309>: DATABASE ENTRY DATE: 2019-04-01
  ref <313>: RELEVANT RESIDUES IN SEQ ID NO: (1)..(1480)
ctgatagtcaacatcggatgagtggcgaactggtgagtaacacgtgggtaacctgcccagaagcgggggataacacttggaaacaggtgctaataccgcataacaacaaaaaccgcatggtttttgtttgaaagatggtttcggctatcacttctggatggacccgcggcgtattagctagttggtggagtaatggttcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgaagaaggctttagggtcgtaaaactctgttgttgaagaagaacgtgtgtgagagtaactgttcacacagtgacggtattcaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggctgtcgtcagctcgtgtcgtgagatgttgggttaagtcccgcaacgagcgcaacccttattgtcagttgccagcatttagttgggcactctggcgagactgccggtgacaaaccggaggaaggtggggatgacgtcaagtcatcatgccccttatgacctgggctacacacgtgctacaatggatggtacaacgagtcgcaaactcgcgagggtaagctaatctcttaaagccattctcagttcggactgtaggctgcaactcgcctacacgaagtcggaatcgctagtaatcgcggatcagcatgccgcggtgaatacgttcccgggccttgtacacaccgcccgtcacaccatgagagtttgcaacacccaaagccggttcggtaaccttcgggagcctgccgtctaaggtggggcagatgattagggtgaagtcgtaacaaggtagccgtaggagaacctgcggctggatcacctcctttctaaggaa

SEQ ID NO: 4713 - DNA, 1575 bp, Lactobacillus kimchiensis
  ref <308>: DATABASE ACCESSION NUMBER: NCBI ACCESSION: NZ_JQCF01000055.1
  ref <309>: DATABASE ENTRY DATE: 2019-04-01
  ref <313>: RELEVANT RESIDUES IN SEQ ID NO: (1)..(1575)
ttaatatgagagtttgatcctggctcaggacgaacgctggcggcatgcctaatacatgcaagtcgaacgaactttcctgatgattgatgcttgcatcatgaatcagatctaagtgagtggcggacgggtgagtaacacgtgggtaacctgcccaaaagagggggataacatttggaaacagatgctaataccgcataacaactattttctcatgattatagtttgaaagatggctctgctatcgcttttggatggacccgcggcgtattagctagttggtgaggtaatagctcaccaaggcgatgatacgtagccgacctgagagggtaatcggccacattgggactgagacacggcccaaactcctacgggaggcagcagtagggaatcttccacaatggacgaaagtctgatggagcaatgccgcgtgagtgaagaaggttttcggatcgtaaaactctgttgttgaagaagaacatgcgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggggggtttccgcccctcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattatcagttgccagcatttagttgggcactctggtgagactgccggtgataaaccggaggaaggtggggacgacgtcaaatcatcatgccccttatgacctgggctacacacgtgctacaatggtcggtacaacgtgctgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgcggctggatcacctcctttctaagga

SEQ ID NO: 4714 - DNA, 699 bp, Lactobacillus kisonensis
  ref <308>: DATABASE ACCESSION NUMBER: NCBI ACCESSION: NZ_AZEB01000088.1
  ref <309>: DATABASE ENTRY DATE: 2019-04-01
  ref <313>: RELEVANT RESIDUES IN SEQ ID NO: (1)..(699)
aactgttcacatcgtgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcatttagttgggcactctagcaagactgccgg

SEQ ID NO: 4715 - DNA, 1574 bp, Lactobacillus kitasatonis
  ref <308>: DATABASE ACCESSION NUMBER: NCBI ACCESSION: NZ_AZFU01000010.1
  ref <309>: DATABASE ENTRY DATE: 2019-04-01
  ref <313>: RELEVANT RESIDUES IN SEQ ID NO: (1)..(1574)
tttaaaatgagagtttgatcctggctcaggacgaacgctggcggcgtgcctaatacatgcaagtcgagcgagcggaaccaacagatttacttcggtaatgacgttgggaaagcgagcggcggatgggtgagtaacacgtggggaacctgcccctaagtctgggataccatttggaaacaggtgctaataccggataagaaagcagatcgcatgatcagcttttaaaaggcggcgtaagctgtcgctaagggatggccccgcggtgcattagctagttggtaaggtaacggcttaccaaggcaacgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaaaaataagtctgatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgcaatctgtagagatacggagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcaagcctgcgaaggcaagcgaatctcttaaagctgttctcagttcggactgcagtctgcaactcgactgcacgaagctggaatcgctagtaatcgcggatcagcatgccgcggtgaatacgttcccgggccttgtacacaccgcccgtcacaccatgggagtctgcaatgcccaaagccggtggcctaaccttcgggaaggagccgtctaaggcagggcagatgactggggtgaagtcgtaacaaggtagccgtaggagaacctgcggctggatcacctcctttctaaggaa

SEQ ID NO: 4716 - DNA, 1489 bp, Lactobacillus koreensis
  ref <308>: DATABASE ACCESSION NUMBER: NCBI ACCESSION: NZ_AZDP01000035.1
  ref <309>: DATABASE ENTRY DATE: 2019-04-01
  ref <313>: RELEVANT RESIDUES IN SEQ ID NO: (1)..(1489)
gtgcttgcactgatttcaacactgaagcgagtggcgaactggtgagtaacacgtgggaaatctgcccagaagcaggggataacacttggaaacaggtgctaataccgcataacaacaagaaccgcatggttcttgtttgaaaggtggcttcggctatcacttctggatgatcccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacttctgagagtaactgttcagaagttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggaaacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4717 - DNA, 1580 bp, Lactobacillus kosoi
  ref <308>: DATABASE ACCESSION NUMBER: NCBI ACCESSION: NZ_BEXE01000061.1
  ref <309>: DATABASE ENTRY DATE: 2019-04-01
  ref <313>: RELEVANT RESIDUES IN SEQ ID NO: (1)..(1580)
taagatgagagtttgatcctggctcaggacgaacgctggcggcgtgcctaatacatgcaagtcgaacgagtcctcccaatttgattttatgcttgcataaatgatttttggattcgggacgagtggcgaactggtgagtaacacgtgggtaacctgccctgaagtaggggataacatttggaaacagatgctaataccgtataattagttggaaccacatggttccaacttgaaagatggctctgctatcactttaggatggacccgcggcgtattagctagttggtgagataaaagctcaccaaggcgatgatacgtagccgacctgagagggtaatcggccacattgggactgagacacggcccagactcctacgggaggcagcagtagggaatcttccacaatggacgaaagtctgatggagcaacgccgcgtgagtgaagaagggtttcggctcgtaaaactctgttgttaaagaagaacaagtgtaagagtaactgtttacgctttgacggtatttaaccagaaagccacggctaactacgtgccagcagccgcggtaatacgtaggtggcaagcgttgtccggatttattgggcgtaaagcgagcgcaggtggttctttaagtctgttgtgaaagccctcagctcaactgaggaagtgcagcggaaactaaaggacttgagtacagaagaggatagtggaactccatgtgtagcggtgaaatgcgtagatatatggaagaacaccagtggcgaaggcggctatctggtctgttactgacactgaggctcgaaagcatgggtagcgaacaggattagataccctggtagtccatgccgtaaacgatgaatactaggtgttggagggtttccgcccttcagtgccgcagctaacgcattaagtattccgcctggggagtacgaccgcaaggttgaaactcaaaggaattgacgggggcccgcacaagtggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattattagttgccagcattaagttgggcactctagtgagactgccggtgataaaccggaggaaggtggggatgacgtcaaatcatcatgccccttatgacctgggctacacacgtgctacaatggatggtacaacgagtcgcgaaaccgcgaggtcaagctaatctcttaaagccattctcagttcggattgcaggctgcaactcgcctgcatgaagttggaatcactagtaatcgtggatcagcatgccacggtgaatacgttcccgggccttgtacacaccgcccgtcacaccatgagagtttgtaacacccaaagacgatggagtaaccttcgggagctagttgtctaaggtgggacagatgattagggtgaagtcgtaacaaggtagccgtaggagaacctgcggctggatcacctcctttctaagga

SEQ ID NO: 4718 - DNA, 1574 bp, Lactobacillus kullabergensis
  ref <308>: DATABASE ACCESSION NUMBER: NCBI ACCESSION: NZ_CP029477.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaatcttaacggaatacttcggtaggaagtcaagagcgcgagcggcggatgggtgagtaacacgtgggcaacctgccctatagcttgggataccacttggaaacaggtgctaataccaaataagcagcaagagcgcatgctcaagctgggaaaggcggctttaaagctgtcactacaggatgggcccgcggtgcattagctagttggcaaggtaacggcctaccaaggcgatgatgcatagccgagttgagagactgaccggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacagggaaagcaactggtctctgtttgacggtaatcaaccagaaagtcacggctaactacgtgccagcagccgcggtaatacgtaggtggcaagcgttgtccggatttattgggcgtaaagcgaacgcaggcgggagaataagtcagctgtgaaagccctcagcttaactggggaactgcagctgaaactatttttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgccagtcctagagataggatgtttccttcgggaacgctaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgagcagcgaacctgcaaaggcaagcgaatctctgaaagctaatctcagttcggattgcactctgcaactcgagtgcatgaagctggaatcgctagtaatcgcggatcagcacgccgcggtgaatacgttcccgggccttgtacacaccgcccgtcacaccatgagagtctgtaatgcccaaagccggtaggataacctgcaaaggagtcagccgtctaaggcaggacagatgattagggtgaagtcgtaacaaggtagccgtaggagaacctgcggctggatcacctcctttctaaggaa

SEQ ID NO: 4719 - DNA, 1478 bp, Lactobacillus kunkeei
  ref <308>: DATABASE ACCESSION NUMBER: NCBI ACCESSION: NZ_BDDX01000020.1
  ref <309>: DATABASE ENTRY DATE: 2019-04-01
  ref <313>: RELEVANT RESIDUES IN SEQ ID NO: (1)..(1478)
tttttggattcggagcgagtggcgaactggtgagtaacacgtgggtaacctgccccgaagcgggggataacatttggaaacaagtgctaataccgcataattagttggaaccgcatggttccaacttgaaagatggctctgctatcactttgggatggacccgcgccgtattagttagttggtgagataaaagcccaccaagacgatgatacgtagccgacctgagagggtaatcggccacattgggactgagacacggcccagactcctacgggaggcagcagtagggaatcttccacaatggacgaaagtctgatggagcaacgccgcgtgagtgatgaaggttttcggatcgtaaaactctgttgttaaagaagaacaagtgttagagtaactgttaacactttgacggtatttaaccagaaagccacggctaactacgtgccagcagccgcggtaatacgtaggtggcaagcgttgtccggatttattgggcgtaaagcgagcgcaggcggttttgtaagtctgctgtgaaagccctcagctcaactgaggaagtgcagtggaaactacaaaacttgagtacagaagaggaaagtggaactccatgtgtagcggtgaaatgcgtagatatatggaagaacaccagtggcgaaggcggctttctggtctgttactgacgctgaggctcgaaagcatgggtagcgaacaggattagataccctggtagtccatgccgtaaacgatgaatactaggtgttggagggtttccgcccttcagtgccgcagctaacgcattaagtattccgcctggggagtacgaccgcaaggttgaaactcaaaggaattgacgggggcccgcacaagtggtggagcatgtggtttaattcgatgctacgcgaagaaccttaccagctcttgacatcttctgccaacccaagagattgggcgttcccttcggggacagaatgacaggtggtgcatggttgtcgtcagctcgtgtcgtgagatgttgggttaagtcccgcaacgagcgcaacccttattattagttgccagcatttagttgggcactctagtgagactgccggtgataaaccggaggaaggtggggacgacgtcaaatcatcatgccccttatgagctgggctacacacgtgctacaatggatggtacaacgagtcgcgaaaccgcgaggtcaagctaatctcttaaagccattctcagttcggattgcaggctgcaactcgcctgcatgaagttggaatcactagtaatcgtggatcagcatgccacggtgaatacgttcccgggccttgtacacaccgcccgtcacaccatgagagtttgtaacacccaaagacgatggggtaaccttttaggagctagtcgtctaaggtgggacagatgattagggtgaagtcgtaacaaggtagccgtaggagaacctgcggctggatcacctcctttctaaggaa

SEQ ID NO: 4720 - DNA, 1585 bp, Lactobacillus lindneri
  ref <308>: DATABASE ACCESSION NUMBER: NCBI ACCESSION: NZ_FUXS01000031.1
  ref <309>: DATABASE ENTRY DATE: 2019-04-01
  ref <313>: RELEVANT RESIDUES IN SEQ ID NO: (1)..(1585)
taaaatgagagtttgatcctggctcaggacgaacgttggcggcgtgcctaatacatgcaagtcgaacgaggtctcctaactgatagctggtgcttgcatcagcttgacgatagatctgaccgagtggcgaactggtgagtaacacgtgggtaacctgcccagaagaaggggataacacctggaaacagatgctaataccgtataacaacgagaaccacatggttctcgtttgaaagatggcttttatgctatcgcttctggatggacccgcggcgtattagctagttggtgagataatagctcaccaaggcaatgatacgtagcagacctgagagggtaatctgccacaatgggactgagacacggcccatactcctacgggaggcagcagtagggaatcttccacaatggacgaaagtctgatggagcaacgccgcgtgagtgaagaagggtttcggctcgtaaaactctgttgttagagaagaacgaccgtgagagcaactgctcacggtgtgacggtatctaaccagaaagtcacggctaactacgtgccagcagccgcggtaatacgtaggtggcaaacgttgtccggatttattgggcgtaaagcgagcgcaggcggttttctaagtctgatgtgaaagccttcggcttaaccggagaagtgcatcggaaactggataacttgagtgcagaaaaggacagtggaacttcatgtgtagcggtgaaatgcgtagatatatgaaggaacaccagtggcgaaggcggctgtctggtctgcatctgacgctgaggctcgaaagcatgggtagcaaacaggattagataccctggtagtccatgccgtaaacgatgaatgctaggtgttgggaggtttccgcctctcagtgccgcagctaacgcattaagcattccgcctggggagtacgaccgcaaggttgaaactcaaaggaattgacggggacccgcacaagcggtggagcatgtggtttaattcgatgctacgcgaagaaccttaccaggacttgacatcttctgttaacctaagagattaggtgtccccttcgggggcagaatgacaggtggtgcatggttgtcgtcagctcgtgtcgtgagatgttgggttaagtcccgcaacgagcgcaacccttgtctttagttgccagcattaagttgggcactctagagagactgccggtgataaaccggaggaaggtggggatgacgtcaaatcatcatgccccttatgtcctgggctacacacgtgctacaatggacggtacaacgagttgcgaaaccgcaaggtcaagctaatctcttaaagccgttctcagttcggattgcaggctgcaactcgcctgcatgaagttggaatcgctagtaatcgtggatcagcatgccacggtgaatacgttcccgggtcttgtacacaccgcccgtcacaccatgagagtttgtaacacccaaagtcggttggataacctttacggagtccgccgcctaaggtgggacagatgattagggtgaagtcgtaacaaggtagccgtaggagaacctgcggctggatcacctcctttctaaggaa

SEQ ID NO: 4721 - DNA, 1084 bp, Lactobacillus malefermentans
  ref <308>: DATABASE ACCESSION NUMBER: NCBI ACCESSION: NZ_AZGJ01000094.1
  ref <309>: DATABASE ENTRY DATE: 2019-04-01
  ref <313>: RELEVANT RESIDUES IN SEQ ID NO: (1)..(1084)
aactgttcacgttgtgacggtatccaaccagaaagccacggctaactacgtgccagcagccgcggtaatacgtaggtggcaagcgttatccggatttattgggcgtaaagagagtgcaggcggtttgttaagtctgatgtgaaagccttcggctcaaccgaagaagtgcattggaaactgataaacttgagtgcagaaaaggacagtggaactccatgtgtagcggtgaaatgcgtagatatatggaagaacaccagtggcgaaggcggctgtctggtctgtaactgacgctgagactcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattatcagttgccagcattaagttgggcactctggtgagactgccggtgataaaccggaggaaggtggggatgacgtcaaatcatcatgccccttatgacctgggctacacacgtgctacaatggacggtacaacgagtcgcgaactcgcgagggtaagctaatctcttaaagccgttctcagttcggactgtaggctgcaactcgcctacacgaagttggaatcgctagtaatcgcggatcagcatgccgcggtgaatacgttcccgggccttgtacacaccgcccgtcacaccatgagagtttgtaacacccaaagtcggttcggtaaccttcgggagccagccgcctaaggtgggacagatgattagggtgaagtcgtaacaaggtagccgtaggagaacctgcggctggatcacctcctttctaagga

SEQ ID NO: 4722 - DNA, 1521 bp, Lactobacillus mali
  ref <308>: DATABASE ACCESSION NUMBER: NCBI ACCESSION: NZ_JQAR01000048.1
  ref <309>: DATABASE ENTRY DATE: 2019-04-01
  ref <313>: RELEVANT RESIDUES IN SEQ ID NO: (1)..(1521)
taaatcgagagtttgatcctggctcaggacgaacgctggcggcgtgcctaatacatgcaagtcgaacgcaaaactttcaccgaatgcttgcattcaccgaaagttttgagtggcgaacgggtgagtaacacgtgggtaacctgcccagaagagggggataacacttggaaacaggtgctaataccgcataacaataaaaaccgcatggtttttatttaaaagatggttttgctatcacttctggatggacccgcggcgtattagctagttggtagggtaaaggcttaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtgtgtgagagtaactgttcatgcagtgacggtatctaaccagaaagccacggctaactacgtgccagcagccgcggtaatacgtaggtggcaagcgttgtccggatttattgggcgtaaagggaacgcaggcggttttttaagtctgatgtgaaagccttcggcttaaccgaagtcatgcattggaaactgaaagacttgagtgcagaagaggagagtggaactccatgtgtagcggtgaaatgcgtagatatatggaagaacaccagtggcgaaagcggctctctggtctgtaactgacgctgaggttcgaaagtgtgggtagcaaacaggattagataccctggtagtccacaccgtaaacgatgaatgctaagtgttggagggtttccgcccttcggtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttctgacagcctaagagattaggtgttcccttcggggacagaatgacaggtggtgcatggttgtcgtcagctcgtgtcgtgagatgttgggttaagtcccgcaacgagcgcaacccttattattagttgccagcattaagttgggcactctagtgagactgccggtgacaaaccggaggaaggtggggatgacgtcaaatcatcatgccccttatgacctgggctacacacgtgctacaatggacggtacaacgagtcgcgaaaccgcgaggtttagctaatctcttaaagccgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtgaggtaacctttatggggccagccgtctaaggtgggacagatgattggggtgaagtcgtaacaa

SEQ ID NO: 4723 - DNA, 902 bp, Lactobacillus manihotivorans
  ref <308>: DATABASE ACCESSION NUMBER: NCBI ACCESSION: NZ_AZEU01000231.1
  ref <309>: DATABASE ENTRY DATE: 2019-04-01
  ref <313>: RELEVANT RESIDUES IN SEQ ID NO: (1)..(902)
aacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcctatgccaatctgagagatcagacgttcccttcggggacatagtgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggacgacgtcaaatcatcatgccccttatgacctgggctacacacgtgctacaatggatggtacaacgagttgcgaacccgcgagggcaagctaatctcttaaagccattctcagtccggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggggtaaccttttaggagctagccgtctaaggtgggacagatgattagggtgaagtcgtaacaaggtagccgtaggagaacctgcggctggatcacctcctttctaagga

SEQ ID NO: 4724 - DNA, 1001 bp, Lactobacillus mellifer
  ref <308>: DATABASE ACCESSION NUMBER: NCBI ACCESSION: NZ_KQ034034.1
  ref <309>: DATABASE ENTRY DATE: 2019-04-01
  ref <313>: RELEVANT RESIDUES IN SEQ ID NO: (1)..(1001)
tccggatttattgggcgtaaagggagcgcaggcggttaaataagtctgggatgtgaaagccctcagctcaactgaggaattgcaacggaaactgtttaacttgagtgcagaagaggagagtggaactccatgtgtagcggtgaaatgcgtagatatatggaagaacaccagtggcgaaggcggctctctggtctgtcactgacgctgaggctcgaaagcatgggtagcgaacaggattagataccctggtagtccatgccgtaaacgatgagtgctaagtgttgggaggtttccgcctttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctcctgcgagcctaagagattaggtgttcccttcggggacaggaagacaggtggtgcatggttgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcaaatcatcatgccccttatgacctgggctacacacgtgctacaatggatggtacaacgagcagcgaactcgtgagggcaagcgaatctctgaaaaccattctcagttcggattgcaggctgcaactcgcctgcatgaagttggaatcgctagtaatcgcggatcagcatgccgcggtgaatacgttcccgggccttgtacacaccgcccgtcacaccatgagagtttgtaacacccaaagccggtgcggcaacccgtaagggagccagccgtctaaggtgggacaaatgattagggtgaagtcgtaacaaggtagccgtaggagaacctgcggctggatcacctcctttctaaggaa

SEQ ID NO: 4725 - DNA, 1571 bp, Lactobacillus mellis
  ref <308>: DATABASE ACCESSION NUMBER: NCBI ACCESSION: NZ_KQ033880.1
  ref <309>: DATABASE ENTRY DATE: 2019-04-01
  ref <313>: RELEVANT RESIDUES IN SEQ ID NO: (1)..(1571)
aaaattgagagtttgatcctggctcaggacgaacgctggcggcgtgcctaatacatgcaagtcgagcgcgggaagtcagggaagccttcgggtggaactggtggaacgagcggcggatgggtgagtaacacgtaggtaacctgccctaaagcgggggataccatctggaaacaggtgctaataccgcataaccccagcagtcacatgagtgctggttgaaagacggcttcggctgtcactttaggatggacctgcggcgtattagctagttggtggagtaacggttcaccaaggcgatgatacgtagccgacctgagagggtaatcggccacattgggactgagacacggcccaaactcctacgggaggcagcagtagggaatcttccacaatggacgcaagtctgatggagcaacgccgcgtggatgaagaaggtcttcggatcgtaaaatcctgttgttgaagaagaacggttgtgagagtaactgctcatagcgtgacggtaatcaaccagaaagtcacggctaactacgtgccagcagccgcggtaatacgtaggtggcaagcgttgtccggatttattgggcgtaaagggagcgcaggcggtcttttaagtctgaatgtgaaagccctcagcttaactgaggaagagcatcggaaactgagagacttgagtgcagaagaggagagtggaactccatgtgtagcggtgaaatgcgtagatatatggaagaacaccagtggcgaaggcggctctctggtctgttactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctcctgcaagcctaagagattaggggttcccttcggggacaggaagacaggtggtgcatggttgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcaaatcatcatgccccttatgacctgggctacacacgtgctacaatggatggtacaatgagaagcgaactcgcgaggggaagctgatctctgaaaaccattctcagttcggattgcaggctgcaactcgcctgcatgaagctggaatcgctagtaatcgcggatcagcatgccgcggtgaatacgttcccgggccttgtacacaccgcccgtcacaccatgagagtttgtaacacccaaagccggtggggtaacctttcggggagctagccgtctaaggtgggacaaatgattagggtgaagtcgtaacaaggtagccgtaggagaacctgcggctggatcacctcctttctaaggaa

SEQ ID NO: 4726 - DNA, 1574 bp, Lactobacillus melliventris
  ref <308>: DATABASE ACCESSION NUMBER: NCBI ACCESSION: NZ_QGLG01000001.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaattttaacagaatacttcggtaggaagttaagagcgcgagcggcggatgggtgagtaacacgtgggcaacctgccctttagcttgggataccacttggaaacaggtgctaataccaaataagcagcaagagcgcatgctcaagctgagaaaggcggctttcgagctgtcactaaaggatgggcccgcggtgcattagctagttggtaaggtaagggcctaccaaggcgatgatgcatagccgagttgagagactgaccggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacaaggaaagcaactgatctttgtttgacggtaatcaaccagaaagtcacggctaactacgtgccagcagccgcggtaatacgtaggtggcaagcgttgtccggatttattgggcgtaaagcgaacgcaggcgggaagataagtcagctgtgaaagcccccagcttaactggggaactgcagctgaaactatgtttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgccagtcctagagataggatgtttccttcgggaacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgagcagcgaacctgcaaaggcaagcgaatctctgaaagctaatctcagttcggattgcactctgcaactcgagtgcatgaagctggaatcgctagtaatcgcggatcagcacgccgcggtgaatacgttcccgggccttgtacacaccgcccgtcacaccatgagagtctgtaatgcccaaagccggtgggataacctgcaaaggagtcagccgtctaaggcaggacagatgattagggtgaagtcgtaacaaggtagccgtaggagaacctgcggctggatcacctcctttctaaggaa

SEQ ID NO: 4727 - DNA, 1583 bp, Lactobacillus metriopterae
  ref <308>: DATABASE ACCESSION NUMBER: NCBI ACCESSION: NZ_RSTD01000008.1
  ref <309>: DATABASE ENTRY DATE: 2019-04-01
  ref <313>: RELEVANT RESIDUES IN SEQ ID NO: (1)..(1583)
ctaatatgagagtttgatcctggctcaggacgaacgctggcggcgtgcctaatacatgcaagtcgagcgaactctcgtgaatgatcaatggtgcttgcaccagagagatttcacatttgagtgagcggcggacgggtgagtaacacgtgggtaacctaccctaaagagggggataacatctggaaacaggtgctaataccgcataacaatttcttccgcatggttgaaatttaaaagatggttttgctatcactttaggatggacccgcggcgtattagctagttggtgaggtaacggctcaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcatgagagtaactgttcatgtattgacggtattcaaccagaaagccacggctaactacgtgccagcagccgcggtaatacgtaggtggcaagcgttgtccggatttattgggcgtaaagcgagtgcaggcggtttattaagtctgatgtgaaagccctcggctcaaccgaggaattgcatcggaaactggtaaacttgagtgcagaagaggagagtggaactccatgtgtagcggtggaatgcgtagatatatggaagaacaccagtggcgaaggcggctctctggtctgtaactgacgctgaggctcgaaagtgtgggtagcaaacaggattagataccctggtagtccacaccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccatgaaagtctaagagattagaggttcccttcggggacatggatacaggtggtgcatggttgtcgtcagctcgtgtcgtgagatgttgggttaagtcccgcaacgagcgcaacccttattgttagttgccatcattaagttgggcactctagcgagactgccggtgacaaaccggaggaaggtggggacgacgtcaaatcatcatgccccttatgacctgggctacacacgtgctacaatggtcagtacaacgtgctgcgaactcgcgagggtaagcaaatcacttaaaactgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacagatgattagggtgaagtcgtaacaaggtagccgtaggagaacctgcggctggatcacctcctttctaaggaa

SEQ ID NO: 4728 - DNA, 1579 bp, Lactobacillus micheneri
  ref <308>: DATABASE ACCESSION NUMBER: NCBI ACCESSION: NZ_POSO01000001.1
  ref <309>: DATABASE ENTRY DATE: 2019-04-01
  ref <313>: RELEVANT RESIDUES IN SEQ ID NO: (1)..(1579)
taagatgagagtttgatcctggctcaggacgaacgctggcggcgtgcctaatacatgcaagtcgaacgagtcctcccaatttgattttatgcttgcataaatgatttttggattcgggacgagtggcgaactggtgagtaacacgtgggtaacctgccctgaagtaggggataacatttggaaacagatgctaataccgtataattagttggaaccacatggttccaacttgaaagatggctctgctatcactttaggatggacccgcggcgtattagctagttggtgagataaaagctcaccaaggcgatgatacgtagccgacctgagagggtaatcggccacattgggactgagacacggcccagactcctacgggaggcagcagtagggaatcttccacaatggacgaaagtctgatggagcaacgccgcgtgagtgaagaagggtttcggctcgtaaaactctgttgttaaagaagaacaagtgtaagagtaactgtttacgctttgacggtatttaaccagaaagccacggctaactacgtgccagcagccgcggtaatacgtaggtggcaagcgttgtccggatttattgggcgtaaagcgagcgcaggtggttctttaagtctgttgtgaaagccctcagctcaactgaggaagtgcagcggaaactaaaggacttgagtacagaagaggatagtggaactccatgtgtagcggtgaaatgcgtagatatatggaagaacaccagtggcgaaggcggctatctggtctgttactgacactgaggctcgaaagcatgggtagcgaacaggattagataccctggtagtccatgccgtaaacgatgaatactaggtgttggagggtttccgcccttcagtgccgcagctaacgcattaagtattccgcctggggagtacgaccgcaaggttgaaactcaaaggaattgacgggggcccgcacaagtggtggagcatgtggtttaattcgatgctacgcgaagaaccttaccaggtcttgacatcttctgccaacctaagagattaggcgttccttcggggacagaatgacaggtggtgcatggttgtcgtcagctcgtgtcgtgagatgttgggttaagtcccgcaacgagcgcaacccttattattagttgccagcattaagttgggcactctagtgagactgccggtgataaaccggaggaaggtggggatgacgtcaaatcatcatgccccttatgacctgggctacacacgtgctacaatggatggtacaacgagtygcgaaaccgcgaggtcaagctaatctcttaaagccattctcagttcggattgcaggctgcaactcgcctgcatgaagttggaatcactagtaatcgtggatcagcatgccacggtgaatacgttcccgggccttgtacacaccgcccgtcacaccatgagagtttgtaacacccaaagacgatggagtaaccttcgggagctagttgtctaaggtgggacagatgattagggtgaagtcgtaacaaggtagccgtaggagaacctgcggctggatcacctcctttctaagga

SEQ ID NO: 4729 - DNA, 1574 bp, Lactobacillus mindensis
  ref <308>: DATABASE ACCESSION NUMBER: NCBI ACCESSION: NZ_AZEZ01000067.1
  ref <309>: DATABASE ENTRY DATE: 2019-04-01
  ref <313>: RELEVANT RESIDUES IN SEQ ID NO: (1)..(1574)
taatatgagagtttgatcctggctcaggacgaacgctggcggcatgcctaatacatgcaagtcgaacgaaccatcctgaagattgaagcttgcttcatgattcagaccttggtgagtggcggacgggtgagtaacacgtgggtaacctgccctaaagtgggggataacatctggaaacaggtgctaataccgcataacaacagtcttcacatgatcactgtttaaaagatggctctgctatcgcttttggatggacccgcggcgtattagctagttggtgaggtaaaggctcaccaaggcgatgatacgtagccgacctgagagggtaatcggccacattgggactgagacacggcccaaactcctacgggaggcagcagtagggaatcttccacaatgggcgaaagcctgatggagcaatgccgcgtgagtgaagaaggttttcggatcgtaaaactctgttgttgaagaagaatatgcgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgctgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgcggctggatcacctcctttctaagga

SEQ ID NO: 4730 - DNA, 617 bp, Lactobacillus mixtipabuli
  ref <308>: DATABASE ACCESSION NUMBER: NCBI ACCESSION: NZ_BCMF01000024.1
  ref <309>: DATABASE ENTRY DATE: 2019-04-01
  ref <313>: RELEVANT RESIDUES IN SEQ ID NO: (1)..(617)
gcaacgccgcgtgagtgaagaagggtttcggctcgtaaaactctgttgttgaagaagaacacatctgagagtaactgttcaggtgttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatactaggtgttggagggtttccgcccttcagtgccgcagctaacgcattaagtattccgcctggggagtacgaccgcaaggttgaaactcaaaggaattgacgggggcccgcacaagcggtggagcatgtggtttaattcgaagctacgcgaagaaccttaccaggtcttgacatactgtgctaacc

SEQ ID NO: 4731 - DNA, 1589 bp, Lactobacillus mucosae
  ref <308>: DATABASE ACCESSION NUMBER: NCBI ACCESSION: NZ_UHJM01000007.1
  ref <309>: DATABASE ENTRY DATE: 2019-04-01
  ref <313>: RELEVANT RESIDUES IN SEQ ID NO: (1)..(1589)
tttatatgagagtttgatcctggctcaggatgaacgccggcggtgtgcctaatacatgcaagtcgaacgcgttggcccaactgattgaacgtgcttgcacggacttgacgttggtttaccagcgagtggcggacgggtgagtaacacgtaggtaacctgccccaaagcgggggataacatttggaaacagatgctaataccgcataacagtttgaatcgcatgattcaaatttaaaagatggcttcggctatcactttgggatggacctgcggcgcattagcttgttggtagggtaacggcctaccaaggctgtgatgcgtagccgagttgagagactgatcggccacaatggaactgagacacggtccatactcctacgggaggcagcagtagggaatcttccacaatgggcgcaagcctgatggagcaacaccgcgtgagcgaagaagggtttcggctcgtaaagctctgttgttagagaagaacgtgcgtgagagcaactgttcacgcagtgacggtatctaaccagaaagtccacggctaactacgtgccagcagccgcggtaatacgtaggtggcaagcgttatccggatttattgggcgtaaagcgagcgcaggcggtttgataagtctgatgtgaaagcctttggcttaaccaaagaagtgcatcggaaactgtcagacttgagtgcagaagaggacagtggaactccatgtgtagcggtggaatgcgtagatatatggaaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagtcgcgaactcgcgagggcaagctaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgcaacacccaaagtcggtggggtaaacccttcggggagctagccgcctaaggtggggcagatgattagggtgaagtcgtaacaaggtagccgtaggagaacctgcggctggatcacctcctttctaaggaa

SEQ ID NO: 4732 - DNA, 1571 bp, Lactobacillus murinus
  ref <308>: DATABASE ACCESSION NUMBER: NCBI ACCESSION: NZ_QZFR01000166.1
  ref <309>: DATABASE ENTRY DATE: 2019-04-01
  ref <313>: RELEVANT RESIDUES IN SEQ ID NO: (1)..(1571)
taaattgagagtttgatcctggctcaggatgaacgctggcggcgtgcctaatacatgcaagtcgaacgaaacttctttatcaccgagtgcttgcactcaccgataaagagttgagtggcgaacgggtgagtaacacgtgggcaacctgcccaaaagagggggataacacttggaaacaggtgctaataccgcataaccatagttaccgcatggtaactatgtaaaaggtggctatgctaccgcttttggatgggcccgcggcgcattagctagttggtggggtaaaggcttaccaaggcaatgatgcgtagccgaactgagaggttgatcggccacattgggactgagacacggcccaaactcctacgggaggcagcagtagggaatcttccacaatgggcgaaagcctgatggagcaacgccgcgtgggtgaagaaggtcttcggatcgtaaaaccctgttgttagagaagaaagtgcgtgagagtaactgttcacgtttcgacggtatctaaccagaaagccacggctaactacgtgccagcagccgcggtaatacgtaggtggcaagcgttatccggatttattgggcgtaaagggaacgcaggcggtcttttaagtctgatgtgaaagccttcggcttaaccggagtagtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaagtgttggagggtttccgcccttcagtgctgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcttttgacaatcctagagataggactttcccttcggggacaaaatgacaggtggtgcatggttgtcgtcagctcgtgtcgtgagatgttgggttaagtcccgcaacgagcgcaacccttattgttagttgccagcattaagttgggcactctagcaagactgccggtgacaaaccggaggaaggtggggatgacgtcaaatcatcatgccccttatgacctgggctacacacgtgctacaatggacggtacaacgagtcgcaagaccgcgaggtttagcaaatctcttaaagccgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtggggtaaccttttggagccagccgtctaaggtgggacagatgattagggtgaagtcgtaacaaggtagccgtaggagaacctgcggctggatcacctcctttctaagga

SEQ ID NO: 4733 - DNA, 1574 bp, Lactobacillus musae
  ref <308>: DATABASE ACCESSION NUMBER: NCBI ACCESSION: NZ_BIFW01000015.1
  ref <309>: DATABASE ENTRY DATE: 2019-04-01
  ref <313>: RELEVANT RESIDUES IN SEQ ID NO: (1)..(1574)
taatatgagagtttgatcctggctcaggacgaacgctggcggcatgcctaatacatgcaagtcgtacgcactctcgtgatgattgaagcttgcttcatgattcacattcgagtgagtggcggacgggtgagtaacacgtgggtaacctgccctaaagtgggggataacatctggaaacaggtgctaataccgcataacaactactttcacatgatcgtagtttgaaagatggctctgctatcgcttttggatggacccgcggcgtattagctagttggtgaggtaatagctcaccaaggcaatgatacgtagccgacctgagagggtaatcggccacattgggactgagacacggcccaaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgcggctggatcacctcctttctaagga

SEQ ID NO: 4734 - DNA, 1567 bp, Lactobacillus nagelii
  ref <308>: DATABASE ACCESSION NUMBER: NCBI ACCESSION: NZ_AZEV01000015.1
  ref <309>: DATABASE ENTRY DATE: 2019-04-01
  ref <313>: RELEVANT RESIDUES IN SEQ ID NO: (1)..(1567)
taaaatgagagtttgatcctggctcaggacgaacgctggcggcgtgcctaatacatgcaagtcgaacgaagctgttttaactggtgcttgcaccgacttaaacaactgagtggcgaacgggtgagtaacacgtgggtaacctgccccaaagcgggggataacatttggaaacagatgctaataccgcataaccacagaaaccacatggtttctgtgtcaaagatggtttcggctatcactttgggatggacccgcggcgtattagctagttggtaaggtaatggcttaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgtcagagaagaacgtgtgcgagagtaactgctcgtgcagtgacggtatctggccagaaagccacggctaactacgtgccagcagccgcggtaatacgtaggtggcaagcgttgtccggatttattgggcgtaaagggaacgcaggcggtcttttaagtctgatgtgaaagccttcggcttaaccgaagtcgtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgctgtaaacgatgaatgctaagtgttggagggtttccgcccttcagtgccgcagcaaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttctgatagcctaagagattaggtgttcccttcggggacagaatgacaggtggtgcatggttgtcgtcagctcgtgtcgtgagatgttgggttaagtcccgcaacgagcgcaacccttattgtcagttgccagcattaagttgggcactctggcaagactgccggtgacaaaccggaggaaggtggggatgacgtcaaatcatcatgccccttatgacctgggctacacacgtgctacaatggacgatacaacgagtcgctagaccgcgaggttaagctaatctctgaaagtcgttctcagttcggattgcaggctgcaactcgcctgcatgaagtcggaatcgctagtaatcgcggatcagcatgccgcggtgaatacgttcccgggccttgtacacaccgcccgtcacaccatgagagtttgtaacacccaaagccggtggggtaaccaataggagccagccgtctaaggtgggacagatgattggggtgaagtcgtaacaaggtagccgtaggagaacctgcggctggatcacctcctttctaagga

SEQ ID NO: 4735 - DNA, 1575 bp, Lactobacillus namurensis
  ref <308>: DATABASE ACCESSION NUMBER: NCBI ACCESSION: NZ_AZDT01000040.1
  ref <309>: DATABASE ENTRY DATE: 2019-04-01
  ref <313>: RELEVANT RESIDUES IN SEQ ID NO: (1)..(1575)
ttaagatgagagtttgatcctggctcaggacgaacgctggcggcatgcctaatacatgcaagtcgaacgagttcccgttgattgacgtgcttgcactgatttcaacattggaacgagtggcgaactggtgagtaacacgtggaaaacctgcccagaagcaggggataacacttggaaacaggtgctaataccgtataacaacaaaaaccgcatggtttttgtttgaaaggtggcttcggctatcacttctggatggttccgcggcgcattagcttgttggtggggtaacggctcaccaaggcgatgatgcgtagccgacctgagagggtaatcggccacattgggactgagacacggcccagactcctacgggaggcagcagtagggaatcttccacaatggacgcaagtctgatggagcaatgccgcgtgagtgaagaagggtttcggctcgtaaaactctgttgttgaagaagaacgggtgtcagagtaactgttgacatcgtgacggtattcaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccgaagaagtgcatcggaaactggggaacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatcttagagataagacgttcccttcggggacagaatgacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggacggtacaacgagtcgcaaagtcgcgaggctaagctaatctcttaaagccgttctcagttcggattgcaggctgcaactcgcctacatgaagttggaatcgctagtaatcgcggatcagcatgccgcggtgaatacgttcccgggccttgtacacaccgcccgtcacaccatgagagtttgtaacacccaaagccggtgaggtaaccttttggagccagccgtctaaggtgggacagatgattagggtgaagtcgtaacaaggtagccgtaggagaacctgcggctggatcacctcctttctaaggaa

SEQ ID NO: 4736 - DNA, 1574 bp, Lactobacillus nantensis
  ref <308>: DATABASE ACCESSION NUMBER: NCBI ACCESSION: NZ_AZFV01000069.1
  ref <309>: DATABASE ENTRY DATE: 2019-04-01
  ref <313>: RELEVANT RESIDUES IN SEQ ID NO: (1)..(1574)
taatatgagagtttgatcctggctcaggacgaacgctggcggcatgcctaatacatgcaagtcgaacgaactctggtgatgattgaagcttgcttcatgaatcacatttgagtgagtggcggacgggtgagtaacacgtgggtaacctgcccaaaagtgggggataacatctggaaacaggtgctaataccgcataacaactactttcacatgatcgtagtttaaaagatggctctgctatcgcttttggatggacccgcggcgtattagctagttggtgaggtaaaggctcaccaaggcaatgatacgtagccgacctgagagggtaatcggccacattgggactgagacacggcccaaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaacccttcggggagctagccgtctaaggtgggacaaatgattagggtgaagtcgtaacaaggtagccgtaggagaacctgcggctggatcacctcctttctaagga

SEQ ID NO: 4737 - DNA, 1575 bp, Lactobacillus nasuensis
  ref <308>: DATABASE ACCESSION NUMBER: NCBI ACCESSION: NZ_AZDJ01000014.1
  ref <309>: DATABASE ENTRY DATE: 2019-04-01
  ref <313>: RELEVANT RESIDUES IN SEQ ID NO: (1)..(1575)
atatgagagtttgatcctggctcaggatgaacgctggcggcgtgcctaatacatgcaagtcgaacgaggtattggtgattgaagtcttcggactgatttcaccgcttaccgagtggcggacgggtgagtaacacgtgggtaacctgcccttaagtgggggataacatttggaaacagatgctaataccgcataaacctttggaccacatggtccaaagttgaaaggcggctttcgagctgtcgcttttggatggacccgcggcgtattagctagttggtaaggtaaaggcttaccaaggcgatgatacgtagccgacctgagagggtgatcggccacattgggactgagacacggcccaaactcctacgggaggcagcagtagggaatcttccacaatggacgcaagtctgatggagcaacgccgcgtgagtgaagaaggttttcggatcgtaaaactctgttgttggagaagaacacgtttgagagtaactgttcagacgttgacggtatccaaccagaaagccacggctaactacgtgccagcagccgcggtaatacgtaggtggcaagcgttatccggatttattgggcgtaaagcgagcgcaggcggtttcttaagtctgatgtgaaagccctcggcttaaccgaggaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttctgctattctgagagatcagaagttcccttcggggacggaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggacgacgtcaaatcatcatgccccttatgacctgggctacacacgtgctacaatggccggtacaacgagctgcgaacccgcgagggtaagcgaatctcttaaagccggtctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggggtaacctttcgagggactagccgtctaaggtgggacagatgattagggtgaagtcgtaacaaggtagccgtaggagaacctgcggctggatcacctcctttctaaggaa

SEQ ID NO: 4738 - DNA, 1583 bp, Lactobacillus nodensis
  ref <308>: DATABASE ACCESSION NUMBER: NCBI ACCESSION: NZ_BCWC01000018.1
  ref <309>: DATABASE ENTRY DATE: 2019-04-01
  ref <313>: RELEVANT RESIDUES IN SEQ ID NO: (1)..(1583)
ttaatatgagagtttgatcctggctcaggacgaacgctggcggcgtgcctaatacatgcaagtcgagcgaactctggtttttgaacgatggtgcttgcaccggagtgattaaacatttgagtgagcggcggatgggtgagtaacacgtgggtaacctgccctaaagtgggggataacatttggaaacaagtgctaataccgcataacaacatttaccacatggtttatgtttgaaagatggttctgctatcgctttaggatggacccgcggtgcattagttagttggtgaggtaacggctcaccaagaccgtgatgcatagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggagagtggaactccatgtgtagcggtggaatgcgtagatatatggaagaacatcagtggcgaaggcggctctctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaaggaa

SEQ ID NO: 4739 - DNA, 1575 bp, Lactobacillus odoratitofui
  ref <308>: DATABASE ACCESSION NUMBER: NCBI ACCESSION: NZ_AZEE01000005.1
  ref <309>: DATABASE ENTRY DATE: 2019-04-01
  ref <313>: RELEVANT RESIDUES IN SEQ ID NO: (1)..(1575)
ataaattgagagtttgatcctggctcaggacgaacgctggcggcgtgcctaatacatgcaagtcgaacgcatcccgttgaattgaagtgcttgcactgatttttaacatcggatgagtggcgaactggtgagtaacacgtgggtaacctgcccagaagcgggggataacacttggaaacaggtgctaataccgcataacaacaaaaaccgcatggtttttgtttgaaagatggtttcggctatcacttctggatggacccgcggcgtattagctagttggtggagtaatggttcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttgaagaagaacacatctgagagtaactgttcaggtgttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatactgtgctaacctaagagattaggcgttcccttcggggacgcagatacaggtggtgcatggctgtcgtcagctcgtgtcgtgagatgttgggttaagtcccgcaacgagcgcaacccttattgtcagttgccagcattcagttgggcactctggcgagactgccggtgacaaaccggaggaaggtggggatgacgtcaagtcatcatgccccttatgacctgggctacacacgtgctacaatggatggtacaacgagttgcgaactcgcgagagtaagctaatctcttaaagccattctcagttcggactgcaggctgcaactcgcctgcacgaagtcggaatcgctagtaatcgcggatcagcatgccgcggtgaatacgttcccgggccttgtacacaccgcccgtcacaccatgagagtttgcaacacccaaagtcggttcggtaaccttcgggagccagccgcctaaggtggggcagatgattagggtgaagtcgtaacaaggtagccgtaggagaacctgcggctggatcacctcctttctaaggaa

SEQ ID NO: 4740 - DNA, 1568 bp, Lactobacillus oeni
  ref <308>: DATABASE ACCESSION NUMBER: NCBI ACCESSION: NZ_AZEH01000040.1
  ref <309>: DATABASE ENTRY DATE: 2019-04-01
  ref <313>: RELEVANT RESIDUES IN SEQ ID NO: (1)..(1568)
taaaatgagagtttgatcctggctcaggacgaacgctggcggcgtgcctaatacatgcaagtcgaacgcagaatttccaccgagtgcttgcactcaccggaaattctgagtggcgaacgggtgagtaacacgtgggtaacctgcccaaaagagggggataacacttggaaacaggtgctaataccgcataacaacaaaaaccgcctggtttttgtttcaaagatggtttcggctgtcacttttggatggacccgcggcgtattagctagttggtaaggtaacggcttaccaaggcagtgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtgtgtgagagtaactgttcatgcagtgacggtatctaaccagaaagccacggctaactacgtgccagcagccgcggtaatacgtaggtggcaagcgttgtccggatttattgggcgtaaagggaacgcaggcggtcttttaagtctgatgtgaaagccttcggcttaaccgaagtcgtgcattggaaactgagagacttgagtgcagaagaggagagtggaactccatgtgtagcggtgaaatgcgtagatatatggaagaacaccagtggcgaaagcggctctctggtctgtaactgacgctgaggttcgaaagcatgggtagcaaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgctaacctgagagatcaggcgttcccttcggggacaaaatgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacctgggctacacacgtgctacaatggacggtacaacgagtcgcgaaaccgcgaggtttagctaatctcttaaaaccgttctcagttcggattgcaggctgcaactcgcctgcatgaagtcggaatcgctagtaatcgcggatcagcatgccgcggtgaatacgttcccgggccttgtacacaccgcccgtcacaccatgagagtttgtaacacccaaagccggtgcggtaaccttttaggaaccagccgtctaaggtgggacagatgattggggtgaagtcgtaacaaggtagccgtaggagaacctgcggctggatcacctcctttctaagga

SEQ ID NO: 4741 - DNA, 1582 bp, Lactobacillus oligofermentans
  ref <308>: DATABASE ACCESSION NUMBER: NCBI ACCESSION: NZ_LN898144.1
  ref <309>: DATABASE ENTRY DATE: 2019-04-01
  ref <313>: RELEVANT RESIDUES IN SEQ ID NO: (1)..(1582)
tatatgagagtttgatcctggctcaggatgaacgctggcggtatgcctaatacatgcaagtcgaacgcattctcgttttcgattgaaggtgcttgcactagattgaaaaaacattggaatgagtggcggacgggtgagtaacacgtgggtaacctgcccaaaagtggggggataacatttggaaacaaatgctaataccgcataatagttagaaccgcatggttctaatttgaaagatggtttcggctatcacttttggatggacccgcggcgtattagttagttggtgaggtaatggctcaccaagacaatgatacgtagccgaactgagaggttgatcggccacaatgggactgagacacggcccatactcctacgggaggcagcagtagggaatcttccacaatgggcgaaagcctgatggagcaataccgcgtgagtgaagaagggtttcggctcgtaaaactctgttgttggagaagaacgtatgtgatagtaactgatcatgtagtgacggtatccaaccagaaagccacggctaactacgtgccagcagccgcggtaatacgtaggtggcaagcgttatccggatttattgggcgtaaagcgagcgcaggcggttttttaagtctgatgtgaaagcccttggctcaaccaaggaagtgcatcggaaactggaaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtgggtggtttattcgagcacgcgaaaaccttaccaggtcttgacatctagcgccaatcctagagataggacgttcccttcggggacgctaagacaggtggtgcatggttgtcgtcagctcgtgtcgtgagatgttgggttaagtcccgcaacgagcgcaacccttattattagttgccagcattcagttgggcactctagtgagactgccggtgacaaaccggaggaaggtggggacgacgtcaaatcatcatgccccttatgacctgggctacacacgtgctacaatggacggtacaacgagttgcgaactcgcgagggtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagtcggtggggtaaccttcgggagccagccgcctaaggtgggacagatgattagggtgaagtcgtaacaaggtagccgtaggagaacctgcggctggatcacctcctttctaaggaa

SEQ ID NO: 4742 - DNA, 1584 bp, Lactobacillus oris
  ref <308>: DATABASE ACCESSION NUMBER: NCBI ACCESSION: NZ_AZGE01000048.1
  ref <309>: DATABASE ENTRY DATE: 2019-04-01
  ref <313>: RELEVANT RESIDUES IN SEQ ID NO: (1)..(1584)
tttatatgagagtttgatcctggctcaggatgaacgccggcggtgtgcctaatacatgcaagtcgagcgcactggcccaacagaaatgacgtgcttgcactgatttgacgttggattcccagtgagcggcggacgggtgagtaacacgtgggcaacctgccccaaagcgggggataacatttggaaacaggtgctaataccgcataacttggaaaaccacatggttttccaataaaagatggtttcggctatcactttgggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttggagaagaacgtgcgtaagagtaactgtttacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccgaagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaacctcagagatgaggcgttcccttcggggacgcaaagacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggccggtacaacgagcagctaacccgcgagggtgtgcaaatctcttaaagccggtctcagttcggactgcagtctgcaactcgactgcacgaagtcggaatcgctagtaatcgcggatcagcatgccgcggtgaatacgttcccgggccttgtacacaccgcccgtcacaccatggaagtttgtaacgcccaaagtcggtggcctaaccatttggagggagccgcctaaggcgggacagatgactggggtgaagtcgtaacaaggtagccgtaggagaacctgcggctggatcacctcctttctaaggaa

SEQ ID NO: 4743 - DNA, 1102 bp, Lactobacillus oryzae
  ref <308>: DATABASE ACCESSION NUMBER: NCBI ACCESSION: NZ_BBJM01000067.1
  ref <309>: DATABASE ENTRY DATE: 2019-04-01
  ref <313>: RELEVANT RESIDUES IN SEQ ID NO: (1)..(1102)
ggaatcttccacaatggacgaaagtctgatggagcaacgccgcgtgagtgaagaagggtttcggctcgtaaaactctgttgttggagaagaacgaacgtgagagtaactgttcacgttgtgacggtatccaaccagaaagccacggctaactacgtgccagcagccgcggtaatacgtaggtggcaagcgttgtccggatttattgggcgtaaagcgagcgcaggcggtttattaagtctgatgtgaaagccttcggctcaaccggagaagtgcatcggaaactggtaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagttgcgaactcgcgagggtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagtcggttcggtaaccttcgggagccagc

SEQ ID NO: 4744 - DNA, 1419 bp, Lactobacillus otakiensis
  ref <308>: DATABASE ACCESSION NUMBER: NCBI ACCESSION: NZ_AZED01000006.1
  ref <309>: DATABASE ENTRY DATE: 2019-04-01
  ref <313>: RELEVANT RESIDUES IN SEQ ID NO: (1)..(1419)
agtaggggataacacttggaaacaggtgctaataccgtataacaaccaaaaccacatggttttggtttaaaagatggcttcggctatcactttaggatggacccgcggcgtattagcttgttggtaaggtaacggcctaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtcagagtaactgttgacatcttgacggtatccaaccagaaagccacggctaactacgtgccagcagccgcggtaatacgtaggtggcaagcgttgtccggatttattgggcgtaaagcgagcgcaggcggtttcttaggtctgatgtgaaagccttcggcttaaccggagaagtgcatcggaaaccaggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcggggaccagccgtctaaggtgggacagatgattagggtgaagtcgtaacaaggtagccgtaggagaacctgcggctggatcacctcctttctaaggaa

SEQ ID NO: 4745 - DNA, 1576 bp, Lactobacillus ozensis
  ref <308>: DATABASE ACCESSION NUMBER: NCBI ACCESSION: NZ_AYYQ01000014.1
  ref <309>: DATABASE ENTRY DATE: 2019-04-01
  ref <313>: RELEVANT RESIDUES IN SEQ ID NO: (1)..(1576)
taagatgagagtttgatcctggctcaggacgaacgctggcggcgtgcctaatacatgcaagtcgaacgcgtcctcgttaaaaattggtgcttgcattaatttttaacattgggacgagtggcgaactggtgagtaacacgtggataacctgccctgaagtatgggataacatttggaaacaagtgctaataccgtataattagtaaaagtcgcatgacttctacttgaaagatggttctgctatcgctttaggatggatccgcggcgtattagctagttggtgagataaaagcccaccaaggcgatgatacgtagccgacctgagagggtaatcggccacattgggactgagacacggcccagactcctacgggaggcagcagtagggaatcttccacaatggacgaaagtctgatggagcaacgccgcgtgagtgaagaagggtttcggctcgtaaaactctgttgttaaagaagaacaagtgtaagagtaactgtttacgctttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactaaataacttgaatacagaagaggacagtggaactccatgtgtagcggtgaaatgcgtagatatatggaagaacaccagtggcgaaggcggctgtctggtctgttattgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagtggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattattagttgccagcattaagttgggcactctagtgagactgccggtgataaaccggaggaaggtggggatgacgtcaaatcatcatgccccttatgacctgggctacacacgtgctacaatggacggtacaacgagttgcgaaaccgcgaggtcaagctaatctcttaaagccgttctcagttcggattgcaggctgcaactcgcctgcatgaagttggaatcactagtaatcgtggatcagcatgccacggtgaatacgttcccgggccttgtacacaccgcccgtcacaccatgagagtttgtaacacccaaagccggtggggtaaccttttaggagctagccgtctaaggtgggacagatgattagggtgaagtcgtaacaaggtagccgtaggagaacctgcggctggatcacctcctttctaagga

SEQ ID NO: 4746 - DNA, 1093 bp, Lactobacillus panis
  ref <308>: DATABASE ACCESSION NUMBER: NCBI ACCESSION: NZ_AZGM01000112.1
  ref <309>: DATABASE ENTRY DATE: 2019-04-01
  ref <313>: RELEVANT RESIDUES IN SEQ ID NO: (1)..(1093)
tgagagtaactgttcatgcagtgacggtattcaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggccggtacaacgagcagctaacccgcgagggtgtgcaaatctcttaaagccggtctcagttcggactgcagtctgcaactcgactgcacgaagtcggaatcgctagtaatcgcggatcagcatgccgcggtgaatacgttcccgggccttgtacacaccgcccgtcacaccatggaagtttgcaatgcccaaagtcagtggcctaaccattttggagggagctgcctaaggcagggcagatgactggggtgaagtcgtaacaaggtagccgtaggagaacctgcggctggatcacctcctttctaaggaa

SEQ ID NO: 4747 - DNA, 1576 bp, Lactobacillus panisapium
  ref <308>: DATABASE ACCESSION NUMBER: NCBI ACCESSION: NZ_NPNH01000009.1
  ref <309>: DATABASE ENTRY DATE: 2019-04-01
  ref <313>: RELEVANT RESIDUES IN SEQ ID NO: (1)..(1576)
aaaaatgagagtttgatcctggctcaggacgaacgctggcggcgtgcctaatacatgcaagtcgagcgagcaattttaacggaataccttcgggtaggaagataaaagcgcgagcggcggatgggtgagtaacacgtgggcaacctgccctttagcttgggataccacttggaaacaggtgctaataccaaataagaagcaagagcgcatgctcaagctatgaaaggcggctttcgagctgtcactaaaggatgggcccgcggagcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggataggggtagtaactgattcttatttgacggtaatcaaccagaaagtcacggctaactacgtgccagcagccgcggtaatacgtaggtggcaagcgttgtccggatttattgggcgtaaagcgaacgcaggcgggagaacaagtcagctgtgaaagccctcggcttaaccggggaagtgcagctgaaactgtttttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgaaaagcctagagataggtaatacccttcggggacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgaggagcaagcctgtgaaggcaagcgaatctcttaaagctaatctcagttcggattgcactctgcaactcgagtgcatgaagctggaatcgctagtaatcgcggatcagcatgccgcggtgaatacgttcccgggccttgtacacaccgcccgtcacaccatgagagtctgtaatacccaaagccggtaagataacctgtaaaggagtcagccgtctaaggtaggacagatgattagggtgaagtcgtaacaaggtagccgtaggagaacctgcggctggatcacctcctttctaaggaa

SEQ ID NO: 4748 - DNA, 1581 bp, Lactobacillus pantheris
  ref <308>: DATABASE ACCESSION NUMBER: NCBI ACCESSION: NZ_BCVS01000179.1
  ref <309>: DATABASE ENTRY DATE: 2019-04-01
  ref <313>: RELEVANT RESIDUES IN SEQ ID NO: (1)..(1581)
tttatatgagagtttgatcctggctcaggatgaacgctggcggcgtgcctaatacatgcaagtcgagcgaacttaactaaatgaatgcggtgcttgcaccaagtgattttagagcggtgagcggcggatgggtgagtaacacgtgggtaacctgcctctaagcaggggataacatttggaaacagatgctaataccgtataaatcctaaaaccacatggttttaggctgaaaggcggcttcggctgtcacttagagatggacccgcggcgtattagctagttggtgaggtaatggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttgaagaagaacacgtttgagagtaactgttcagacgttgacggtattcaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgaatgctgaagaggacagtggaactccatgtgtagcggtgaaatgcgtagatatatggaagaacaccagtggcgaaggcggctgtctggtcagttattgacgctgaggctcgaaagcatgggtagcgaacaggattagataccctggtagtccatgccgtaaacgatgaatactaggtgttggagggtttccgcccttcagtgccgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgctatttctagagatagaaagttcccttcggggacggaatgacaggtggtgcatggttgtcgtcagctcgtgtcgtgagatgttgggttaagtcccgcaacgagcgcaacccttatgactagttgccagcattaagttgggcactctagtaagactgccggtgacaaaccggaggaaggtggggacgacgtcaaatcatcatgccccttatgacctgggctacacacgtgctacaatggttggtacaacgagttgcgaactcgcgagggtaagctaatctcttaaagccaatctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagccggtggggcaacccttcggggagctagccgtctaaggtgggacagatgattagggtgaagtcgtaacaaggtagccgtaggagaacctgcggctggatcacctcctttctaaggaa

SEQ ID NO: 4749 - DNA, 1575 bp, Lactobacillus parabrevis
  ref <308>: DATABASE ACCESSION NUMBER: NCBI ACCESSION: NZ_JQCI01000059.1
  ref <309>: DATABASE ENTRY DATE: 2019-04-01
  ref <313>: RELEVANT RESIDUES IN SEQ ID NO: (1)..(1575)
ttaagatgagagtttgatcctggctcaggacgaacgctggcggcatgcctaatacatgcaagtcgaacgagcttccgttgaatgacgtgcttgcactgatttcaacaatgaagcgagtggcgaactggtgagtaacacgtgggtaacttgcccagaagcaggggataacacttggaaacaggtgctaataccgtataacaacagaaaccgcatggtttctgtttgaaaggtggtttcggctatcacttctggatggacccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacactcttgagagtaactgttcaggagttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4750 - DNA, 1584 bp, Lactobacillus parabuchneri
  ref <308>: DATABASE ACCESSION NUMBER: NCBI ACCESSION: NZ_MSBH01000014.1
  ref <309>: DATABASE ENTRY DATE: 2019-04-01
  ref <313>: RELEVANT RESIDUES IN SEQ ID NO: (1)..(1584)
ttaagatgagagtttgatcctggctcaggacgaacgctggcggcgtgcctaatacatgcaagtcgaacgcgtcttggttattgatgttaagtgcttgcatttaactgatttaacattgagacgagtggcgaactggtgagtaacacgtgggtaacctgcccttgaagtaggggataacacttggaaacaggtgctaataccgtataacaaccaaaaccacctggttttggtttaaaagatggcttcggctatcactttaggatggacccgcggcgtattagcttgttggtaaggtaacggcctaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtgagagtaactgttcacatcttgacggtatccaaccagaaagccacggctaactacgtgccagcagccgcggtaatacgtaggtggcaagcgttgtccggatttattgggcgtaaagcgagcgcaggcggtttcttaggtctgatgtgaaagccttcggcttaaccggagaagtgcatcggaaaccaggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcggggaccagccgtctaaggtgggacagatgattagggtgaagtcgtaacaaggtagccgtaggagaacctgcggctggatcacctcctttctaaggaa

SEQ ID NO: 4751 - DNA, 1579 bp, Lactobacillus paracasei
  ref <308>: DATABASE ACCESSION NUMBER: NCBI ACCESSION: NZ_RCYL01000095.1
  ref <309>: DATABASE ENTRY DATE: 2019-04-01
  ref <313>: RELEVANT RESIDUES IN SEQ ID NO: (1)..(1579)
tttatatgagagtttgatcctggctcaggatgaacgctggcggcgtgcctaatacatgcaagtcgaacgagttctcgttgatgatcggtgcttgcaccgagattcaacatggaacgagtggcggacgggtgagtaacacgtgggtaacctgcccttaagtgggggataacatttggaaacagatgctaataccgcatagatccaagaaccgcatggttcttggctgaaagatggcgtaagctatcgcttttggatggacccgcggcgtattagctagttggtgaggtaatggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4752 - DNA, 1573 bp, Lactobacillus paracollinoides
  ref <308>: DATABASE ACCESSION NUMBER: NCBI ACCESSION: NZ_CP014924.1
  ref <309>: DATABASE ENTRY DATE: 2019-04-01
  ref <313>: RELEVANT RESIDUES IN SEQ ID NO: (1)..(1573)
ataaaatgagagtttgatcctggctcaggatgaacgctggcggcgtgcctaatacatgcaagtcgaacgcatcccgttaaatgaagtgcttgcacggattttaacatcggatgagtggcgaactggtgagtaacacgtgggtaacctgcccagaagcaggggataacacttggaaacaggtgctaataccgtataacaacaaaaaccgcatggtttttgtttgaaaggtggtttcggctatcacttctggatggacccgcggcgtattagctagttggtggagtaacggttcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacacgtttgagagtaactgttcagacgttgacggtattcaaccagaaagccacggctaactacgtgccagcagccgcggtaatacgtaggtggcaagcgttatccggatttattgggcgtaaagcgagcgcaggcggttacttaagtctgatgtgaaagccttcggcttaaccggagaagtgcatcggaaactgggtaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatactgtgctaacctaagagattaggcgttcccttcggggacgcagatacaggtggtgcatggctgtcgtcagctcgtgtcgtgagatgttgggttaagtcccgcaacgagcgcaacccttattgtcagttgccagcatttagttgggcactctggcgagactgccggtgacaaaccggaggaaggtggggatgacgtcaagtcatcatgccccttatgacctgggctacacacgtgctacaatggatggtacaacgagttgcgaactcgcgagagcaagctaatctcttaaagccattctcagttcggactgtaggctgcaactcgcctacacgaagtcggaatcgctagtaatcgcggatcagcatgccgcggtgaatacgttcccgggccttgtacacaccgcccgtcacaccatgagagtttgcaacacccaaagtcggttcggtaaccttcgggagccagccgcctaaggtggggcagatgattagggtgaagtcgtaacaaggtagccgtaggagaacctgcggctggatcacctcctttctaaggaa

SEQ ID NO: 4753 - DNA, 1583 bp, Lactobacillus parafarraginis
  ref <308>: DATABASE ACCESSION NUMBER: NCBI ACCESSION: NZ_AZFZ01000113.1
  ref <309>: DATABASE ENTRY DATE: 2019-04-01
  ref <313>: RELEVANT RESIDUES IN SEQ ID NO: (1)..(1583)
ttaagatgagagtttgatcctggctcaggacgaacgctggcggcgtgcctaatacatgcaagtcgaacgcgtcttggttaatgatgttaggtgcttgcatttaactgatttaacattgagacgagtggcgaactggtgagtaacacgtgggtaacctgccctgaagtgggggataacacttggaaacaggtgctaataccgcataacaacgaaaaccacatggttttcgtttgaaagatggcttcggctgtcacttttggatggacccgcggcgtattagcttgttggtgaggtaacggctcaccaaggccatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgatagagtaactgttatcatcttgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagggcatcggaaaccgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgctaacctaagagattaggcgttcccttcggggacggaatgacaggtggtgcatggttgtcgtcagctcgtgtcgtgagatgttgggttaagtcccgcaacgagcgcaacccttattgtcagttgccagcatttagttgggcactctggcgagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgcaggctgcaactcgcctgcatgaagttggaatcgctagtaatcgtggatcagcatgccacggtgaatacgttcccgggccttgtacacaccgcccgtcacaccatgagagtttgtaacacccaaagccggtgaggtaaccttcgggaaccagccgtctaaggtgggacagatgattagggtgaagtcgtaacaaggtagccgtaggagaacctgcggctggatcacctcctttctaaggaa

SEQ ID NO: 4754 - DNA, 1581 bp, Lactobacillus paragasseri; identical to SEQ ID NO: 4627
  ref <308>: DATABASE ACCESSION NUMBER: NCBI ACCESSION: NZ_AP018549.1
  ref <309>: DATABASE ENTRY DATE: 2019-04-01
  ref <313>: RELEVANT RESIDUES IN SEQ ID NO: (1)..(1581)

SEQ ID NO: 4755 - DNA, 1584 bp, Lactobacillus parakefiri
  ref <308>: DATABASE ACCESSION NUMBER: NCBI ACCESSION: NZ_NCXA01000085.1
  ref <309>: DATABASE ENTRY DATE: 2019-04-01
  ref <313>: RELEVANT RESIDUES IN SEQ ID NO: (1)..(1584)
ttaagatgagagtttgatcctggctcaggacgaacgctggcggcgtgcctaatacatgcaagtcgaacgcgtcttggccaatgatttcaggtgcttgcacttgaaagatttgacattgagacgagtggcgaactggtgagtaacacgtgggtaacctgcccttgaagtaggggataacacttggaaacaggtgctaataccgtataacaaccaaaaccacctggttttggtttaaaagacggcttcggctgtcactttaggatggacccgcggcgtattagcttgttggtaaggtaacggcctaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaaccgttgtcagagcaactgttgacagcttgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcggggaccagccgtctaaggtgggacagatgattagggtgaagtcgtaacaaggtagccgtaggagaacctgcggctggatcacctcctttctaaggaa

SEQ ID NO: 4756 - DNA, 1575 bp, Lactobacillus paralimentarius
  ref <308>: DATABASE ACCESSION NUMBER: NCBI ACCESSION: NZ_MXAL01000025.1
  ref <309>: DATABASE ENTRY DATE: 2019-04-01
  ref <313>: RELEVANT RESIDUES IN SEQ ID NO: (1)..(1575)
ttaatatgagagtttgatcctggctcaggacgaacgctggcggcatgcctaatacatgcaagtcgaacgaaccatcctgaagattgaagcttgcttcatgattcagaccttggtgagtggcggacgggtgagtaacacgtgggtaacctgcccagaagtgggggataacatttggaaacaagtgctaataccgcataacaacttagatcacatgatctttgtttaaaagatggttttgctatctcttctggatggacccgcggcgtattagctagttggtgaggtaatagctcaccaaggcgatgatacgtagccgacctgagagggtaatcggccacattgggactgagacacggcccaaactcctacgggaggcagcagtagggaatcttccacaatggacgaaagtctgatggagcaatgccgcgtgagtgaagaaggttttcggatcgtaaaactctgttgttgaagaagaacatatgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagcttagagataagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgataaaccggaggaaggtggggacgacgtcaaatcatcatgccccttatgacctgggctacacacgtgctacaatggtcggtacaacgtgctgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagtcggtggggtaacccttcggggaactagccgcctaaggtgggacaaatgattagggtgaagtcgtaacaaggtagccgtaggagaacctgcggctggatcacctcctttctaagga

SEQ ID NO: 4757 - DNA, 1576 bp, Lactobacillus paraplantarum
  ref <308>: DATABASE ACCESSION NUMBER: NCBI ACCESSION: NZ_CP032744.1
  ref <309>: DATABASE ENTRY DATE: 2019-04-01
  ref <313>: RELEVANT RESIDUES IN SEQ ID NO: (1)..(1576)
ttaatttgagagtttgatcctggctcaggacgaacgctggcggcgtgcctaatacatgcaagtcgaacgaactctggtaatgattggtgcttgcatcatgaattacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctttctaaggaa

SEQ ID NO: 4758 - DNA, 1572 bp, Lactobacillus pasteurii
  ref <308>: DATABASE ACCESSION NUMBER: NCBI ACCESSION: NZ_AYZN01000032.1
  ref <309>: DATABASE ENTRY DATE: 2019-04-01
  ref <313>: RELEVANT RESIDUES IN SEQ ID NO: (1)..(1572)
aaaaatgagagtttgatcctggctcaggacgaacgctggcggcgtgcctaatacatgcaagtcgagcgagcttgcctatagaagttcttcggaacggacatagatacaagctagcggcggatgggtgagtaacacgtgggtaacctgcccttaagtctgggataccatttggaaacaggtgctaataccggataacaactctagctgcatggctagagcttgaaaggcggcgcaagctgtcgctaaaggatggacccgcggtgcattagctagttggtagggtaaaggcctaccaaggcattgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaagatagagagagtaactgatctttatttgacggtaatcaaccagaaagtcacggctaactacgtgccagcagccgcggtaatacgtaggtggcaagcgttgtccggatttattgggcgtaaagcgagcgcaggcggaaagataagtctgatgtgaaagccctcggctcaaccgaggaactgcatcggaaactgtctttcttgagtgcagaagaggagagtggaactccatgtgtagcggtggaatgcgtagatatatggaagaacaccagtggcgaaagcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgcaatcccaagagattgggagttcccttcggggacgctaagacaggtggtgcatggctgtcgtcagctcgtgtcgtgagatgttgggttaagtcccgcaacgagcgcaacccttgtcattagttgccagcattgagttgggcactctaatgagactgccggtgacaaaccggaggaaggtggggacgacgtcaagtcatcatgccccttatgacctgggctacacacgtgctacaatgggcagtacaacgagcagcgagcctgcgaaggcaagcaaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaacgcccaaagccggtggcctaaccgtaaggagggagccgtctaaggcagggcagatgactggggtgaagtcgtaacaaggtagccgtaggagaacctgcggctggatcacctcctttctaaggaa

SEQ ID NO: 4759 - DNA, 1575 bp, Lactobacillus paucivorans
  ref <308>: DATABASE ACCESSION NUMBER: NCBI ACCESSION: NZ_JQCA01000055.1
  ref <309>: DATABASE ENTRY DATE: 2019-04-01
  ref <313>: RELEVANT RESIDUES IN SEQ ID NO: (1)..(1575)
ataagatgagagtttgatcctggctcaggacgaacgctggcggcatgcctaatacatgcaagtcgaacgcgtcttcgttaactgaagtgcttgcacggacgttaaccataagacgagtggcgaactggtgagtaacacgtaggaaacctgcccagaagcaggggataacacttggaaacaggtgctaataccgtataacaacgaaaaccgcatggttttcgtttgaaagatggtttcggctatcacttctggatggtcctgcggcgtattagttagttggtgaggtaaaggcccaccaagacgatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttgaagaagaacgggtgcaagagtaactgtttgcatcgtgacggtattcaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggaaacttgagtgcagaagaggacagtggaactccatgtgtagcggtggaatgcgtagatatatggaagaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatgggcggtacaacgagttgcgaagtcgtgaggctaagctaatctcttaaagccgctctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4760 - DNA, 1073 bp, Lactobacillus pentosiphilus
  ref <308>: DATABASE ACCESSION NUMBER: NCBI ACCESSION: NZ_BCMI01000059.1
  ref <309>: DATABASE ENTRY DATE: 2019-04-01
  ref <313>: RELEVANT RESIDUES IN SEQ ID NO: (1)..(1073)
ggcagcagtagggaatcttccacaatggacgaaagtctgatggagcaacgccgcgtgagtgaagaagggtttcggctcgtaaaactctgttgttgaagaagaacacacttgagagtaactgttcaggtgttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatactaggtgttggagggtttccgcccttcagtgccgcagctaacgcattaagtattccgcctggggagtacgaccgcaaggttgaaactcaaaggaattgacgggggcccgcacaagcggtggagcatgtggtttaattcgaagctacgcgaagaaccttaccaggtcttgacatactgtgctaacctaagagattaggcgttcccttcggggacgcagatacaggtggtgcatggctgtcgtcagctcgtgtcgtgagatgttgggttaagtcccgcaacgagcgcaacccttattgtcagttgccagcatttagttgggcactctggcgagactgccggtgacaaaccggaggaaggtggggatgacgtcaagtcatcatgccccttatgacctgggctacacacgtgctacaatggatggtacaacgagtcgcaaacccgcgagggcaagctaatctcttaaagccattctcagttcggactgcaggctgcaactcgcctgcacgaagtcggaatcgctagtaatcgcggatcagcatgccgcggtgaatacgttcccgggccttgtacacaccgcccgtcacaccatgagagttt

SEQ ID NO: 4761 - DNA, 1576 bp, Lactobacillus pentosus
  ref <308>: DATABASE ACCESSION NUMBER: NCBI ACCESSION: NZ_FLYG01000003.1
  ref <309>: DATABASE ENTRY DATE: 2019-04-01
  ref <313>: RELEVANT RESIDUES IN SEQ ID NO: (1)..(1576)
ttaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgtttccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagcaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctttctaaggaa

SEQ ID NO: 4762 - DNA, 1238 bp, Lactobacillus perolens
  ref <308>: DATABASE ACCESSION NUMBER: NCBI ACCESSION: NZ_AZEC01000044.1
  ref <309>: DATABASE ENTRY DATE: 2019-04-01
  ref <313>: RELEVANT RESIDUES IN SEQ ID NO: (1)..(1238)
ttaaatgagagtttgatcctggctcaggacgaacgctggcggcgtgcctaatacatgcaagtcgaacgaggtttgatcagtttgcggtggtgcttgcatcaccaattaccgattaaaccgagtggcggacgggtgagtaacacgtgggtaacctgcccttcagcaggggataacatttggaaacagatgctaataccgtataaccacggagaccgcatggtctccgggtaaaagatggcgaaagctatcactgagggatggacccgcggcgtattagccagttggtggggtaatggcctaccaaagcgatgatacgtagccgacctgagagggtaatcggccacattgggactgagacacggcccaaactcctacgggaggcagcagtagggaatcttccacaatggacgcaagtctgatggagcaacgccgcgtgagtgaagaaggctttcgggtcgtaaaactctgttattgaagaagaacgtgtgtgagagtaactgctcatgcagtgacggtattcaaccagaaagtcacggctaactacgtgccagcagccgcggtaatacgtaggtggcaagcgttgtccggatttattgggcgtaaagcgagtgcaggcggttttttaagtctgatgtgaaagccttcggcttaaccgaagaagtgcatcggaaactgggaaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgaatactaagtgttggggggtttccgcccctcagtgctgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgccaagctgagagatcagccgttcccttcggggacagaatgacaggtggtgcatggttgtcgtcagctcgtgtcgtgagatgttgggttaagtcccgcaacgagcgcaacccttatgattagttgccagcattcagttgggcactctagtcagactgccggtgataaaccggaggaaggcggggatgacgtcaaatcatcatgcc

SEQ ID NO: 4763 - DNA, 1576 bp, Lactobacillus plantarum
  ref <308>: DATABASE ACCESSION NUMBER: NCBI ACCESSION: NZ_OKQT01000105.1
  ref <309>: DATABASE ENTRY DATE: 2019-04-01
  ref <313>: RELEVANT RESIDUES IN SEQ ID NO: (1)..(1576)
ttaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctttctaaggaa

SEQ ID NO: 4764 - DNA, 1572 bp, Lactobacillus pobuzihii
  ref <308>: DATABASE ACCESSION NUMBER: NCBI ACCESSION: NZ_JQCN01000019.1
  ref <309>: DATABASE ENTRY DATE: 2019-04-01
  ref <313>: RELEVANT RESIDUES IN SEQ ID NO: (1)..(1572)
taaaatgagagtttgatcctggctcaggacgaacgctggcggcgtgcctaatacatgcaagtcgaacgcaatcttttaacaatgagtgcttgcactcagcgttttaagtgcgagtggcgaacgggtgagtaacacgtgggcaatctgcccaaaagtgggggataacacttggaaacaggtgctaataccgcatcaaccgactgaccgcctggtcggtcgggcaaagacggcgtaagctgtcgcttttggatgagcccgcggcgtattaactagttggtaaggtaacggcttaccaaggtgatgatacgtagccgaactgagaggttgatcggccacattgggactgagacacggcccaaactcctacgggaggcagcagtagggaatcttccacaatggacgcaagtctgatggagcaacgccgcgtgtatgaagaaggtcttcggatcgtaaaatactgttgtcagagaagaacacgggataaagtaactattgttccgctgacggtatctgaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagaagtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtggggagcgaacaggattagataccctggtagtccacgctgtaaacgatgaatgctaggtgttggagggtttccgcccttcggtgccgcagttaacgcactaagcattccgcctggggagtacgatcgcaagattgaaactcaaaggaattgacgggggcccgcacaagcggtggagcatgtggtttaattcgaagcaacgcgaagaaccttaccaggtcttgacatcttttgaccatctgagagatcagaatttcccttcggggacaaaatgacaggtggtgcatggctgtcgtcagctcgtgtcgtgagatgttgggttaagtcccacaacgagcgcaacccttattgtcagttgccagcattgagttgggcactctggcgagactgccggtgacaaaccggaggaaggtggggatgacgtcaagtcatcatgccccttatgacctgggctacacacgtgctacaatggacgatacaacgagtcgcgagaccgcgaggtttagctaatctctgaaagtcgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtgcggtaaccatttggagccagccgtctaaggtgggacagatgattggggtgaagtcgtaacaaggtagccgtaggagaacctgcggctggatcacctcctttctaaggaa

SEQ ID NO: 4765 - DNA, 1585 bp, Lactobacillus pontis
  ref <308>: DATABASE ACCESSION NUMBER: NCBI ACCESSION: NZ_PNFV01000020.1
  ref <309>: DATABASE ENTRY DATE: 2019-04-01
  ref <313>: RELEVANT RESIDUES IN SEQ ID NO: (1)..(1585)
tttatatgagagtttgatcctggctcaggatgaacgccggcggtgtgcctaatacatgcaagtcgagcgcactggcccaactgatatgacgtgcttgcacagatttgacgatggattaccagtgagcggcggacgggtgagtaacacgtgggcaacctgccctggagcgggggataacatttggaaacagatgctaataccgcataacaatcaaaaccacatggttttgatttcaaagatggcttcggctatcactccaggatgggcccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaaactctgttgttgaagaagaacgtgcgtgagagtaactgttcacgcagtgacggtattcaaccagaaagtcacggctaactacgtgccagcagccgcggtaatacgtaggtggcaagcgttatccggatttattgggcgtaaagcgagcgcaggcggttacttaagtctgatgtgaaagccttcggcttaaccgaagaagtgcatcggaaactgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggtcggtacaacgagtcgctaacccgcgagggcaagctaatctcttaaagccgatctcagttcggactgtaggctgcaactcgcctacacgaagtcggaatcgctagtaatcgcggatcagcatgccgcggtgaatacgttcccgggccttgtacacaccgcccgtcacaccatggaagtttgtaacgcccaaagtcggtggcctaaccattatggagggagccgcctaaggcgggacagatgactggggtgaagtcgtaacaaggtagccgtaggagaacctgcggctggatcacctcctttctaaggaa

SEQ ID NO: 4766 - DNA, 1574 bp, Lactobacillus porcinae
  ref <308>: DATABASE ACCESSION NUMBER: NCBI ACCESSION: NZ_RHNS01000032.1
  ref <309>: DATABASE ENTRY DATE: 2019-04-01
  ref <313>: RELEVANT RESIDUES IN SEQ ID NO: (1)..(1574)
ttatatgagagtttgatcctggctcaggatgaacgctggcggcgtgcctaatacatgcaagtcgaacgaggttttgttgaatgatttcttcggaatgaattctttaaaaccgagtggcggacgggtgagtaacacgtgggtaacctgcccttaagtgggggataacatttggaaacagatgctaataccgcataaacctcagaaacacatgtttctgagttgaaaggcggctttcgagctgtcgcttttggatggacccgcggcgtattagctagttggtgaggtaaaggctcaccaaggcagtgatacgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaaactctgttgttggagaagaacacgtttgagagtaactgttcagacgttgacggtatccaaccagaaagccacggctaactacgtgccagcagccgcggtaatacgtaggtggcaagcgttatccggatttattgggcgtaaagcgagcgcaggcggtttcttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcctatgctaatctgagagatcagacgttcccttcggggacatagtgacaggtggtgcatggttgtcgtcagctcgtgtcgtgagatgttgggttaagtcccgcaacgagcgcaacccttatgactagttgccagcattaagttgggcactctagtaagactgccggtgacaaaccggaggaaggtggggacgacgtcaaatcatcatgccccttatgacctgggctacacacgtgctacaatggatggtacaacgagttgcgaacccgcgagggcaagctaatctcttaaagccattctcagtccggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggggtaaccttttaggagctagccgtctaaggtgggacagatgattagggtgaagtcgtaacaaggtagccgtaggagaacctgcggctggatcacctcctttctaagga

SEQ ID NO: 4767 - DNA, 857 bp, Lactobacillus psittaci
  ref <308>: DATABASE ACCESSION NUMBER: NCBI ACCESSION: NZ_AZFB01000023.1
  ref <309>: DATABASE ENTRY DATE: 2019-04-01
  ref <313>: RELEVANT RESIDUES IN SEQ ID NO: (1)..(857)
ggaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccacctaagagattaggttttcccttcggggacaaagagacaggtggtgcatggctgtcgtcagctcgtgtcgtgagatgttgggttaagtcccgcaacgagcgcaacccttgttaatagttgccagcattaagttgggcactctattaagactgccggtgacaaaccggaggaaggtggggatgacgtcaagtcatcatgccccttatgacctgggctacacacgtgctacaatgggcagtacaacgagaagcgaacctgtgaaggcaagcggatctcttaaagctgttctcagttcggactgtaggctgcaactcgcctacacgaagctggaatcgctagtaatcgcggatcagcacgccgcggtgaatacgttcccgggccttgtacacaccgcccgtcacaccatgagagtttgtaacacccaaagtcggtgaggtaacctttggagccagccgcctaaggtgggacagatgattagggtgaagtcgtaacaaggtagccgtaggagaacctgcggctggatcacctcctttctaaggaa

SEQ ID NO: 4768 - DNA, 1580 bp, Lactobacillus quenuiae
  ref <308>: DATABASE ACCESSION NUMBER: NCBI ACCESSION: NZ_POSN01000005.1
  ref <309>: DATABASE ENTRY DATE: 2019-04-01
  ref <313>: RELEVANT RESIDUES IN SEQ ID NO: (1)..(1580)
taagatgagagtttgatcctggctcaggacgaacgctggcggcgtgcctaatacatgcaagtcgaacgagtcctcccaatttgattttatgcttgcataaatgatttttggattcgggacgagtggcgaactggtgagtaacacgtgggtaacctgccctaaagcaggggataacatttggaaacaagtgctaataccgtataattagttggaaccacatggttccaacttgaaagatggctctgctatcactttaggatggacccgcggcgtattagctagttggtgagataatggctcaccaaggcgatgatacgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaaactctgttgttaaagaagaacaagygtaagagtaactgtttacgctttgacggtatttaaccagaaagccacggctaactacgtgccagcagccgcggtaatacgtaggtggcaagcgttgtccggatttattgggcgtaaagcgagcgcaggtggttttctaagtctgttgtgaaagccctcagctcaactgaggaagtgcagcggaaactagaagacttgagtacagaagaggatagtggaactccatgtgtagcggtgaaatgcgtagatatatggaagaacaccagtggcgaaggcggctatctggtctgttactgacactgaggctcgaaagcatgggtagcgaacaggattagataccckggtagtccaygccgtaaacgatgartgctaagtgttgggaggtttccgcctctcagtgctgcagctaacgcattaagcactccgcctggggagtacgrccgcaaggttraaactcaaaggaattgacgggggcccgcacaagcggtggagcatgtggtttaattcgawgcaacgcgaagaaccttaccaggtcttgacatcttstgcmarccywagagatwrggcgttyccttcgggracastaagacaggtgstgcatggytgtcgtcagctcgtgtygtgaratgttgggttaagtcccgcaacgagcgcaacccttattattagttgccagcattaagttgggcactctagtgagactgccggtgataaaccggaggaaggtggggatgacgtcaaatcatcatgccccttatgacctgggctacacacgtgctacaatggatggtacaacgagtcgcraaaccgcgaggtcaagctaatctcttaaagccattctcagttcggattgcaggctgcaactcgcctgcatgaagttggaatcactagtaatcgtggatcagcatgccacggtgaatacgttcccgggccttgtacacaccgcccgtcacaccatgagagtttgtaacacccaaagacgatggagtaaccttcgggagctagttgtctaaggtgggacagatgattagggtgaagtcgtaacaaggtagccgtaggwgaacctgcggctggatcacctcctttctaagga

SEQ ID NO: 4769 - DNA, 1582 bp, Lactobacillus raoultii
  ref <308>: DATABASE ACCESSION NUMBER: NCBI ACCESSION: NZ_LS422986.1
  ref <309>: DATABASE ENTRY DATE: 2019-04-01
  ref <313>: RELEVANT RESIDUES IN SEQ ID NO: (1)..(1582)
ttaagatgagagtttgatcctggctcaggacgaacgctggcggcgtgcctaatacatgcaagtcgaacgcgtctgggttgatgatttttggtgcttgcatcaaactgattcaactttagacgagtggcgaactggtgagtaacacgtgggtaacctgccccgaagcgggggataacatttggaaacagatgctaataccgcataacaactaaaaccgcctggttttagtttgaaagatggtttcggctgtcactttgggatggacccgcggcgtattagctagttggtggggtaacggctcaccaaggcaatgatacgtagccgacctgagagggtaatcggccacattgggactgagacacggcccaaactcctacgggaggcagcagtagggaatcttccacaatggacgcaagtctgatggagcaacgccgcgtgagtgatgaagggtttcggctcgtaaaactctgttgttggagaagaacgggtgtcagagtaactgttgacatcgtgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagggcatcggaaaccgggagacttgagtgcagaagaggacagtggaactccatgtgtagcggtgaaatgcgtagatatatggaagaacaccagtggcgaaggcggctgtctggtctgcaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgctaacctaagagattaggcgttcccttcggggacggaatgacaggtggtgcatggttgtcgtcagctcgtgtcgtgagatgttgggttaagtcccgcaacgagcgcaacccttattgtcagttgccagcattcggttgggcactctggcgagactgccggtgacaaaccggaggaaggtggggatgacgtcaaatcatcatgccccttatgacctgggctacacacgtgctacaatggacggtacaacgagttgcgaaaccgcgaggtcaagctaatctctcaaagccgttctcagttcggattgcaggctgcaactcgcctgcatgaagttggaatcgctagtaatcgtggatcagcatgccacggtgaatacgttcccgggccttgtacacaccgcccgtcacaccatgagagtttgtaacacccaaagccggtgaggtaaccttcgggggccagccgtctaaggtgggacagatgattagggtgaagtcgtaacaaggtagccgtaggagaacctgcggctggatcacctcctttctaaggaa

SEQ ID NO: 4770 - DNA, 1584 bp, Lactobacillus rapi
  ref <308>: DATABASE ACCESSION NUMBER: NCBI ACCESSION: NZ_AZEI01000033.1
  ref <309>: DATABASE ENTRY DATE: 2019-04-01
  ref <313>: RELEVANT RESIDUES IN SEQ ID NO: (1)..(1584)
ttaagatgagagtttgatcctggctcaggacgaacgctggcggcgtgcctaatacatgcaagtcgaacgcgtcttggttaaagattttaggtgcttgcatttaaatgatttaacattgagacgagtggcgaactggtgagtaacacgtgggtaacctgcccttgaagtaggggataacacttggaaacaggtgctaataccgtataacaactcaaaccacatggtttgagtttgaaagatggcttcggctgtcactttaggatggacccgcggcgtattagcttgttggtgaggtaacggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtgagagtaactgttcacatcttgacggtatccaaccagaaagccacggctaactacgtgccagcagccgcggtaatacgtaggtggcaagcgttgtccggatttattgggcgtaaagcgagcgcaggcggttttttaggtctgatgtgaaagccttcggcttaaccggagaagtgcatcggaaaccgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcgggaaccaaccgtctaaggtgggacagatgattagggtgaagtcgtaacaaggtagccgtaggagaacctgcggctggatcacctcctttctaaggaa

SEQ ID NO: 4771 - DNA, 1578 bp, Lactobacillus rennini
  ref <308>: DATABASE ACCESSION NUMBER: NCBI ACCESSION: NZ_AYYI01000077.1
  ref <309>: DATABASE ENTRY DATE: 2019-04-01
  ref <313>: RELEVANT RESIDUES IN SEQ ID NO: (1)..(1578)
ttaagatgagagtttgatcctggctcaggacgaacgctggcggcgtgcctaatacatgcaagtcgcacgcacaactgttaaccgatcctgcttgcaggtgacgttaatggacgtgagtggcggacgggtgagtaacacgtgggtaaccaaccctgaagcgggggataacctttggaaacagaggctaataccgcatagtttatcgcgacctcctggtcgcaataataaagacggcttcggctgtcacttcaggacagacccgcggcgtattagctagttggtgggataaaggcctaccaaggcgatgatacgtagccgacctgagagggtaatcggccacattgggactgagacacggcccaaactcctacgggaggcagcagtagggaatcttccacaatggacgcaagtctgatggagcaacgccgcgtgagtgaagaagggtttcggctcgtaaaacgctgttgttggagaagaaccgggggtagagtaactgttatccccttgacggtatccaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccgaagaagggcatcagaaactgagaagcttgaggacagaaaaggaaagtggaactccatgtgtagcggtgaaatgcgtagatatatggaagaacaccagtggcgaaggcggctttctggtctgttactgacgctgaggctcgaaagtatggggagcgaacaggattagataccctggtagtccataccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcctttgaccgctgtcgagagacagtttgcccttcggggccaaagtgacaggtggtgcatggttgtcgtcagctcgtgtcgtgagatgttgggttaagtcccgcaacgagcgcaacccttatgactagttgccagcatttagttgggcactctagtgagactgccggtgacaaaccggaggaaggtggggatgacgtcaaatcagcatgcccctgatgacctgggctacacacgtgctacaatggtcgggacaacgagtagcgcgcccgcgagggttagctaatctctaaaaaccgatctcagttcggattgcaggctgcaactcgcctgcatgaagccggaatcgctagtaatcgcggatcagcatgccgcggtgaatccgttcccgggccttgtacacaccgcccgtcacaccatgagagtttgtaacacccaaagccggtggggcaacccttcggggagctagccgtctaaggtgggacagatgattggggtgaagtcgtaacaaggtagccgtaggagaacctgcggctggatcacctcctttctaaggaa

SEQ ID NO: 4772 - DNA, 1585 bp, Lactobacillus reuteri
  ref <308>: DATABASE ACCESSION NUMBER: NCBI ACCESSION: NZ_CP035790.1
  ref <309>: DATABASE ENTRY DATE: 2019-04-01
  ref <313>: RELEVANT RESIDUES IN SEQ ID NO: (1)..(1585)
tttatatgagagtttgatcctggctcaggataaacgccggcggtgtgcctaatacatgcaagtcgtacgcactggcccaactgattgatggtgcttgcatctgattgacgatggatcaccagtgagtggcggacgggtgagtaacacgtaggtaacctgccccggagcgggggataacatttggaaacagatgataataccgcataacaacaaaagccgcatggcttttgtttgaaagatggctttggctatcactctgggatggacctgcggtgcattagctagttggtaaggtaaaggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgtaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaaactcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaa

SEQ ID NO: 4773 - DNA, 1579 bp, Lactobacillus rhamnosus
  ref <308>: DATABASE ACCESSION NUMBER: NCBI ACCESSION: NZ_LR134331.1
  ref <309>: DATABASE ENTRY DATE: 2019-04-01
  ref <313>: RELEVANT RESIDUES IN SEQ ID NO: (1)..(1579)
tttatatgagagtttgatcctggctcaggatgaacgctggcggcgtgcctaatacatgcaagtcgaacgagttctgattattgaaaggtgcttgcatcttgatttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4774 - DNA, 863 bp, Lactobacillus rodentium
  ref <308>: DATABASE ACCESSION NUMBER: NCBI ACCESSION: NZ_BFBY01000025.1
  ref <309>: DATABASE ENTRY DATE: 2019-04-01
  ref <313>: RELEVANT RESIDUES IN SEQ ID NO: (1)..(863)
aaatgagagtttgatcctggctcaggacgaacgctggcggcgtgcctaatacatgcaagtcgagcgagcgtgcctggatgattttggtgcttgcaccaaatgaaaccagatacaagcgagcggcggacgggtgagtaacacgtgggtaacctgcccaagagactgggataacacctggaaacagatgctaataccggataacaactttagacgcatgtctagagtttgaaagatgggttttctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaagggtttcggctcgtaaagctctgttgttggtgaagaatgatagaggtagtaactggcctttatttgacggtaatcaaccagaaagtcacggctaactacgtgccagcagccgcggtaatacgtaggtggcaagcgttgtccggatttattgggcgtaaagcgagcgcaggcggtttaataagtctgatgtgaaagccttcggctcaaccgaagaattgcatcagaaactgttaaacttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgg

SEQ ID NO: 4775 - DNA, 1583 bp, Lactobacillus rossiae
  ref <308>: DATABASE ACCESSION NUMBER: NCBI ACCESSION: NZ_AZFF01000046.1
  ref <309>: DATABASE ENTRY DATE: 2019-04-01
  ref <313>: RELEVANT RESIDUES IN SEQ ID NO: (1)..(1583)
ttaatttgagagtttgatcctggctcaggatgaacgctggcggcgtgcctaatacatgcaagtcgaacgcacttcggtttttgattgacggtgcttgcaccagattgacgagacattgaagtgagtggcgaacgggtgagtaacacgtgggtaacctgccctaaagtgggggataacatttggaaacagatgctaataccgcataacaacgaaaaccacatggttttcgcttgaaagatggtttcagctatcactttaggatggacccgcggtgcattagctagttggtaaggtaacggcttaccaaggcaatgatgcatagccgagctgagaggctgatcggccacattgggactgagacacggcccagactcctacgggaggcagcagtagggaatcttccacaatgggcgcaagcctgatggagcaacgccgcgtgagtgaagaagggtttcggctcgtaaaactctgttgttaaagaagaacgtatctgagagtaactgttcagatagtgacggtatttaaccagaaagccacggctaactacgtgccagcagccgcggtaatacgtaggtggcaagcgttatccggatttattgggcgtaaagggagtgcaggcggttatttaagtctgatgtgaaagccttcggcttaaccggagaagggcatcggaaactggataacttgagtgcagaagagggtagtggaactccatgtgtagcggtggaatgcgtagatatatggaagaacaccagtggcgaaggcggctacctagtctgtaactgacgctgaggctcgaaagcatgggtagcaaacaggattagataccctggtagtccatgccgtaaacgatgaatactaggtgttagggggtttccgccccttagtgccgcagctaacgcaataagtattccgcctggggagtacgaccgcaaggttgaaactcaaaggaattgacggggacccgcacaagcggtggagcatgtggtttaattcgaagctacgcgaagaaccttaccagggcttgacatcttctgctaatccgagagatcggacgttcccttcggggacggaaagacaggtggtgcatggttgtcgtcagctcgtgtcgtgagatgttgggttaagtcccgcaacgagcgcaacccttatgattagttgccagcattaagttgggcactctaatgagactgccggtgacaaaccggaggaaggtggggacgacgtcaaatcatcatgccccttatgtcctgggctacacacgtgctacaatggatggtacaacgagcagcgaagtcgcgaggccaagcaaatctcttaaagccattctcagttcggactgtaggctgcaactcgcctacacgaagtcggaatcgctagtaatcgcggatcagcatgccgcggtgaatacgttcccgggtcttgtacacaccgcccgtcacaccatgagagtttgtaacacccaaagtcggtggggtaaccttcgggagccaaccgcctaaggtgggacagatgattagggtgaagtcgtaacaaggtagccgtaggagaacctgcggctggatcacctcctttctaaggaa

SEQ ID NO: 4776 - DNA, 1572 bp, Lactobacillus ruminis
  ref <308>: DATABASE ACCESSION NUMBER: NCBI ACCESSION: NZ_FOPI01000002.1
  ref <309>: DATABASE ENTRY DATE: 2019-04-01
  ref <313>: RELEVANT RESIDUES IN SEQ ID NO: (1)..(1572)
ataaattgagagtttgatcctggctcaggacgaacgctggcggcgtgcctaatacatgcaagtcgaacgaagctttctttcaccgaatgcttgcattcaccgaaagaagcttagtggcgaacgggtgagtaacacgtaggcaacctgcccaaaagagggggataacacttggaaacaggtgctaataccgcataaccatgaacaccgcatgatgttcatgtaaaagacggcttttgctgtcacttttggatgggcctgcggcgtattaacttgttggtggggtaatggcctaccaaggtgatgatacgtagccgaactgagaggttgatcggccacattgggactgagacacggcccaaactcctacgggaggcagcagtagggaatcttccacaatggacgaaagtctgatggagcaacgccgcgtgaatgaagaaggccttcgggtcgtaaaattctgttgtcagagaagaacgtgcgtgagagtaactgttcacgtattgacggtatctgaccagaaagccacggctaactacgtgccagcagccgcggtaatacgtaggtggcgagcgttgtccggatttattgggcgtaaagggaacgcaggcggtcttttaagtctgatgtgaaagccttcggcttaaccgaagtagtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcttctgacaattccagagatggaacgttcccttcggggacagaatgacaggtggtgcatggttgtcgtcagctcgtgtcgtgagatgttgggttaagtcccgcaacgagcgcaacccttattgtcagttgccatcattaagttgggcactctggcgagactgccggtgacaaaccggaggaaggtggggatgacgtcaaatcatcatgccccttatgacctgggctacacacgtgctacaatggacggtacaacgagtcgctaactcgcgagggcaagctaatctcttaaagccgttctcagttcggattgcaggctgcaactcgcctgcatgaagtcggaatcgctagtaatcgcgaatcagcatgtcgcggtgaatacgttcccgggccttgtacacaccgcccgtcacaccatgagagtttgtaacacccaaagtcggtggggtaaccttttggagccagccgcctaaggtgggacagatgattggggtgaagtcgtaacaaggtagccgtaggagaacctgcggctggatcacctcctttctaaggaa

SEQ ID NO: 4777 - DNA, 1280 bp, Lactobacillus saerimneri
  ref <308>: DATABASE ACCESSION NUMBER: NCBI ACCESSION: NZ_AZFP01000065.1
  ref <309>: DATABASE ENTRY DATE: 2019-04-01
  ref <313>: RELEVANT RESIDUES IN SEQ ID NO: (1)..(1280)
ccaaggcaatgatacgtagccgagttgagagactgatcggccacattgggactgagacacggcccagactcctacgggaggcagcagtagggaatcttccacaatggacgcaagtctgatggagcaacgccgcgtgagcgaagaaggtcttcggatcgtaaaactctgttgttagagaagaacacgggtgagagtaactgttcacctgttgacggtatctaaccagcaagtcacggctaactacgtgccagcagccgcggtaatacgtaggtggcaagcgttatccggatttattgggcgtaaagggaacgcaggcggttctttaagtctgatgtgaaagccttcggcttaaccgaagatgtgcattggaaactggggaacttgagtgcagaagaggagagtggaactccatgtgtagcggtgaaatgcgtagatatatggaagaacaccagtggcgaaagcggctctctggtctgtaactgacgctgaggttcgaaagcgtgggtagcgaacaggattagataccctggtagtccacgccgtaaacgatgaatgctaggtgttggagggtttccgcccttcagtgccgcagctaacgcactaagcattccgcctggggagtacgaccgcaaggttgaaactcaaaggaattgacgggggcccgcacaagcggtggagcatgtggtttaattcgaagctacgcgaagaaccttaccaggtcttgacatcttttgaccacctaagagattaggttttcccttcggggacaaaatgacaggtggtgcatggttgtcgtcagctcgtgtcgtgagatgttgggttaagtcccgcaacgagcgcaacccttgttgtcagttgccagcattcagttgggcactctggcgagactgccggtgacaaaccggaggaaggtggggatgacgtcaaatcatcatgccccttatgacctgggctacacacgtgctacaatgggcagtacaacgagtcgcgaaaccgcgaggtttagcaaatctcttaaagctgctctcagttcggactgtaggctgcaactcgcctacacgaagtcggaatcgctagtaatcgcgaatcagcatgtcgcggtgaatacgttcccgggccttgtacacaccgcccgtcacaccatgagagtttgtaacacccaaagccggtggggtaaccttttggagccagccgtctaaggtgggacagatgattggggtgaagtcgtaacaaggtagccgtaggagaacctgcggctggatcacctcctttctaaggaa

SEQ ID NO: 4778 - DNA, 1578 bp, Lactobacillus sakei
  ref <308>: DATABASE ACCESSION NUMBER: NCBI ACCESSION: NZ_OVTU01000010.1
  ref <309>: DATABASE ENTRY DATE: 2019-04-01
  ref <313>: RELEVANT RESIDUES IN SEQ ID NO: (1)..(1578)
tcgagagtttgatcctggctcaggacgaacgctggcggcgtgcctaatacatgcaagtcgaacgcactctcgtttagattgaaggagcttgctcctgattgataaacatttgagtgagtggcggacgggtgagtaacacgtgggtaacctgccctaaagtgggggataacatttggaaacagatgctaataccgcataaaacctaacaccgcatggtgtagggttgaaagatggtttcggctatcactttaggatggacccgcggtgcattagttagttggtgaggtaaaggctcaccaagaccgtgatgcatagccgacctgagagggtaatcggccacactgggactgagacacggcccagactcctacgggaggcagcagtagggaatcttccacaatggacgaaagtctgatggagcaacgccgcgtgagtgaagaaggttttcggatcgtaaaactctgttgttggagaagaatgtatctgatagtaactgatcaggtagtgacggtatccaaccagaaagccacggctaactacgtgccagcagccgcggtaatacgtaggtggcaagcgttgtccggatttattgggcgtaaagcgagcgcaggcggtttcttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggatggtacaacgagttgcgagaccgcgaggtttagctaatctcttaaaaccattctcagttcggattgtaggctgcaactcgcctacatgaagccggaatcgctagtaatcgcggatcagcatgccgcggtgaatacgttcccgggccttgtacacaccgcccgtcacaccatgagagtttgtaacacccaaagccggtgaggtaacccttcggggagccagccgtctaaggtgggacagatgattagggtgaagtcgtaacaaggtagccgtaggagaacctgcggctggatcacctcctttctaaggaa

SEQ ID NO: 4779 - DNA, 1570 bp, Lactobacillus salivarius
  ref <308>: DATABASE ACCESSION NUMBER: NCBI ACCESSION: NZ_LT604074.1
  ref <309>: DATABASE ENTRY DATE: 2019-04-01
  ref <313>: RELEVANT RESIDUES IN SEQ ID NO: (1)..(1570)
taaaatgagagtttgatcctggctcaggacgaacgctggcggcgtgcctaatacatgcaagtcgaacgaaactttcttacaccgaatgcttgcattcaccgtaagaagttgagtggcggacgggtgagtaacacgtgggtaacctgcctaaaagaaggggataacacttggaaacaggtgctaataccgtatatctctaaggatcgcatgattcttagatgaaagatggttctgctgtcgcttttagatggacccgcggcgtattaactagttggtggggtaacggcctaccaaggtgatgatacgtagccgaactgagaggttgatcggccacattgggactgagacacggcccaaactcctacgggaggcagcagtagggaatcttccacaatggacgcaagtctgatggagcaacgccgcgtgagtgaagaaggtcttcggatcgtaaaactctgttgttagagaagaacacgagtgagagtaactgttcattcgatgacggtatctaaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagtagtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaggtgttggagggtttccacccttcagtgccgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcctttgaccacctaagagattaggttttcccttcgggggcaaagtgacaggtggtgcatggctgtcgtcagctcgtgtcgtgagatgttgggttaagtcccgcaacgagcgcaacccttgttgtcagttgccagcattaagttgggcactctggcgagactgccggtgacaaaccggaggaaggtggggacgacgtcaagtcatcatgccccttatgacctgggctacacacgtgctacaatggacggtacaacgagtcgcaagaccgcgaggtttagctaatctcttaaagccgttctcagttcggattgtaggctgcaactcgcctacatgaagtcggaatcgctagtaatcgcgaatcagcatgtcgcggtgaatacgttcccgggccttgtacacaccgcccgtcacaccatgagagtttgtaacacccaaagccggtggggtaaccgcaaggagccagccgtctaaggtgggacagatgattggggtgaagtcgtaacaaggtagccgtaggagaacctgcggctggatcacctcctttctaaggaa

SEQ ID NO: 4780 - DNA, 1587 bp, Lactobacillus sanfranciscensis
  ref <308>: DATABASE ACCESSION NUMBER: NCBI ACCESSION: NZ_QRFO01000046.1
  ref <309>: DATABASE ENTRY DATE: 2019-04-01
  ref <313>: RELEVANT RESIDUES IN SEQ ID NO: (1)..(1587)
ttaaaatgagagtttgatcctggctcaggacgaacgttggcggcgtgcctaatacatgcaagtcgaacgaagtcgcccaattgattcttagtgcttgcactaagatgattttggatccgactgagtggcgaactggtgagtaacacgtgggtaacctgcccagaagaaggggataacacctggaaacagatgctaataccgtataacaacaagaaccacatggttcttgtttgaaagctggcctttgtgctagtgcttctggatggacccgcggcgtattagctagttggtgagataatagctcaccaaggcaatgatacgtagcagacctgagagggtaatctgccacaatgggactgagacacggcccatactcctacgggaggcagcagtagggaatcttccacaatggacgaaagtctgatggagcaacgccgcgtgagtgaagaagggtttcggctcgtaaaactctgttgttagagaagaacagccgtgagagcaactgctcacggtatgacggtatctaaccagaaagtcacggctaactacgtgccagcagccgcggtaatacgtaggtggcaaacgttgtccggatttattgggcgtaaagggagcgcaggcggtttattaagtctgatgtgaaagccttcggcttaaccggagaagtgcatcggaaactgataaacttgagtgcagaaaaggatagtggaacttcatgtgtagcggtgaaatgcgtagatatatgaaggaacaccagtggcgaaggcggctatctggtctgtaactgacgctgaggctcgaaagcatgggtagcaaacaggattagataccctggtagtccatgccgtaaacgatgaatgctaggtgttggaaggtttccgcctttcagtgccgcagctaacgcattaagcattccgcctggggagtacgaccgcaaggttgaaactcaaaggaattgacggggacccgcacaagcggtggagcatgtggtttaattcgatgctacgcgaagaaccttaccaggacttgacatcttctgccaatctaagagattagacgttcccttcggggacagaatgacaggtggtgcatggttgtcgtcagctcgtgtcgtgagatgttgggttaagtcccgcaacgagcgcaacccttgtctttagttgccagcattaagttgggcactctagagagactgccggtgataaaccggaggaaggtggggatgacgtcaaatcatcatgccccttatgtcctgggctacacacgtgctacaatgggcgatacaacgagttgcgaaaccgcgaggtcaagctaatctcttaaagtcgttctcagttcggattgcagtctgcaactcgactgcatgaagttggaatcgctagtaatcgtggatcagcatgccacggtgaatacgttcccgggtcttgtacacaccgcccgtcacaccatgagagtttgtaacacccaaagtcggttggataacctttttaggagtccgccgcctaaggtgggacagatgattagggtgaagtcgtaacaaggtagccgtaggagaacctgcggctggatcacctcctttctaaggaa

SEQ ID NO: 4781 - DNA, 1582 bp, Lactobacillus saniviri
  ref <308>: DATABASE ACCESSION NUMBER: NCBI ACCESSION: NZ_JQCE01000025.1
  ref <309>: DATABASE ENTRY DATE: 2019-04-01
  ref <313>: RELEVANT RESIDUES IN SEQ ID NO: (1)..(1582)
ttgatatgagagtttgatcctggctcaggatgaacgctggcggcgtgcctaatacatgcaagtcgaacgagttctggttaatgatggcggtgcttgcaccaatagatttaacatttgaacgagtggcggacgggtgagtaacacgtgggtaacctgccctaaagtgggggataacatttggaaacagatgctaataccgcataaatcttggaacctcatggttccaagctgaaagatggcgtaagctatcgcttttggatggacccgcggcgtattagctagttggtgaggtaaaggctcaccaaggcgatgatacgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaaactctgttgttggagaagaacgtacgtgagagtaactgttcacgtagtgacggtatccaaccagaaagccacggctaactacgtgccagcagccgcggtaatacgtaggtggcaagcgttatccggatttattgggcgtaaagcgagcgcaggcggtttcttaagtctgatgtgaaagccctcggctcaaccgaggaagtgcatcggaaactgggaaacttgagtgcagaagaggacagtggaactccatgtgtagcggtggaatgcgtagatatatggaagaacaccagtggcgaaggcggctgtctggtctgtaactgacgctgaggctcgaaagcatgggtagcgaacaggattagataccctggtagtccatgccgtaaacgatgaatactaagtgttggagggtttccgcccttcagtgctgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgctattctaagagattagaagttcccttcggggacagaatgacaggtggtgcatggttgtcgtcagctcgtgtcgtgagatgttgggttaagtcccgcaacgagcgcaacccttatgactagttgccagcattaagttgggcactctaatcagactgccggtgacaaaccggaggaaggtggggatgacgtcaaatcatcatgccccttatgacctgggctacacacgtgctacaatggatggtacaacgagtcgcaaaaccgcgaggttaagctaatctcttaaagccattctcagtccggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggggtaaccttttaggagctagccgtctaaggtgggacagatgattagggtgaagtcgtaacaaggtagccgtaggagaacctgcggctggatcacctcctttctaaggaa

SEQ ID NO: 4782 - DNA, 1568 bp, Lactobacillus satsumensis
  ref <308>: DATABASE ACCESSION NUMBER: NCBI ACCESSION: NZ_AZFQ01000022.1
  ref <309>: DATABASE ENTRY DATE: 2019-04-01
  ref <313>: RELEVANT RESIDUES IN SEQ ID NO: (1)..(1568)
taaaatgagagtttgatcctggctcaggacgaacgctggcggcgtgcctaatacatgcaagtcgtacgcagtttcttcatcgagtgcttgcactcaccgaagaaactgagtggcgaacgggtgagtaacacgtgggtaacctgcccaaaagagggggataacacttggaaacaggtgctaataccgcataacaacaaaaaccgcctggtttttgtttaaaagatggtttcggctatcacttttggatggacccgcggcgtattagctagttggtaaggtaacggcttaccaaggcagtgatacgtagccgaactgagaggttgatcggccacattgggactgagacacggcccaaactcctacgggaggcagcagtagggaatcttccacaatggacgcaagtctgatggagcaacgccgcgtgagtgaagaaggttttcggatcgtaaaactctgttgttagagaagaacgtgtgtgagagtaactgttcatgcagtgacggtatctaaccagaaagccacggctaactacgtgccagcagccgcggtaatacgtaggtggcaagcgttgtccggatttattgggcgtaaagggaacgcaggcggtcttttaagtctgatgtgaaagccttcggcttaaccgaagtcgtgcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgctgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgctaacctgagagatcaggcgttcccttcggggacaaaatgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgacctgggctacacacgtgctacaatggacggtacaacgagtcgcaagaccgcgaggtttagctaatctcttaaaaccgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtgcggtaaccttttaggagccagccgtctaaggtgggacagatgattggggtgaagtcgtaacaaggtagccgtaggagaacctgcggctggatcacctcctttctaagga

SEQ ID NO: 4783 - DNA, 1583 bp, Lactobacillus secaliphilus
  ref <308>: DATABASE ACCESSION NUMBER: NCBI ACCESSION: NZ_JQBW01000001.1
  ref <309>: DATABASE ENTRY DATE: 2019-04-01
  ref <313>: RELEVANT RESIDUES IN SEQ ID NO: (1)..(1583)
ttacatgagagtttgatcctggctcaggatgaacgccggcggtgtgcctaatacatgcaagtcgaacgcgttggcccaactgattgacggtgcttgcacctgattgacgttggattaccaacgagtggcggacgggtgagtaacacgtaggcaacctgcccagaagcgggggacaacatttggaaacaagtgctaataccgcataaatcctcaaaccgcatggtttgaggctgaaagatggtttcggctatcacttctggatgggcctgcggcgcattagcttgttggtggggtaacggcctaccaaggctatgatgcgtagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttgaagaagaacgtgcgtgagagtaactgttcacgcagtgacggtattcaaccagaaagtcacggctaactacgtgccagcagccgcggtaatacgtaggtggcaagcgttatccggatttattgggcgtaaagcgagcgcaggcggtttgctaagtctgatgtgaaagccttcggcttaaccggagaagtgcatcggaaactggctaacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctcagagatgaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatgggcgatacaacgagctgcaaacccgcgagggtaagctaatctcttaaaatcgttctcagttcggactgtagtctgcaacccgactacacgaagtcggaatcgctagtaatcgcggatcagcatgccgcggtgaatacgttcccgggccttgtacacaccgcccgtcacaccatggaagtttgcaatgcccaaagccggtggccgaaccttcgggacggagccgtctaaggcagggcagatgactggggtgaagtcgtaacaaggtagccgtaggagaacctgcggctggatcacctcctttctaaggaa

SEQ ID NO: 4784 - DNA, 1569 bp, Lactobacillus selangorensis
  ref <308>: DATABASE ACCESSION NUMBER: NCBI ACCESSION: NZ_JQAZ01000013.1
  ref <309>: DATABASE ENTRY DATE: 2019-04-01
  ref <313>: RELEVANT RESIDUES IN SEQ ID NO: (1)..(1569)
attttatatgagagtttgatcctggctcaggacgaacgctggcggcgtgcctaatacatgcaagtcgaacgaactttcatcgagtgcttgcacttgatgaaagtgagtggcggacgggtgagtaacacgtgggtaacctgccccaaagcggggaataacatttggaaacagatgctaataccgcataacaacgaagaccacatggtcttcgtttgaaagacggcgtaagctgtcactttgggatggacccgcggcgtattagctagttggtaaggtaacggcctaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtgggtgagagtaactgctcatccagtgacggtatctaaccagaaagccacggctaactacgtgccagcagccgcggtaatacgtaggtggcaagcgttgtccggatttattgggcgtaaagcgagcgcaggcggtcttttaagtctgatgtgaaagccctcggcttaaccgaggaagtgcatcggaaactggaagacttgaatgcagaagaggagagtggaactccatgtgtagcggtgaaatgcgtagatatatggaagaacaccagtggcgaaggcggctctctggtctgtgattgacgctgaggctcgaaagcgtgggtagcaaacaggattagataccctggtagtccacgccgtaaacgatgaatactaagtgttggagggtttccgcccttcagtgctgcagctaacgcattaagtattccgcctggggagtacgaccgcaaggttgaaactcaaaggaattgacgggggcccgcacaagcggtggagcatgtggtttaattcgacgcaacgcgaagaaccttaccaggtcttgacatcttctgctatctctagaaatagagagttcccttcggggacagaatgacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggatgacgtcaaatcatcatgccccttatgacctgggctacacacgtgctacaatggatggtacaacgagtcgctaaaccgcgaggtcaagctaatctcttaaaaccattctcagttcggattgcaggctgcaactcgcctgcatgaagttggaatcgctagtaatcgcggatcagcacgccgcggtgaatacgttcccgggccttgtacacaccgcccgtcacaccatgagagtttgtaacacccgaagtcggtggggcaaccccgtaaggggagctagccgcctaaggtgggacagatgattagggtgaagtcgtaacaaggtagccgtaggagaacctgcggctggatcacctcctttctaaggaa

SEQ ID NO: 4785 - DNA, 1582 bp, Lactobacillus senioris
  ref <308>: DATABASE ACCESSION NUMBER: NCBI ACCESSION: NZ_AYZR01000005.1
  ref <309>: DATABASE ENTRY DATE: 2019-04-01
  ref <313>: RELEVANT RESIDUES IN SEQ ID NO: (1)..(1582)
aaactgagagtttgatcctggctcaggacgaacgctggcggcgtgcctaatacatgcaagtcgaacgcgtcttggtgaatgatcggcggtgcttgcaccaaagagatttcacaatgagacgagtggcgaactggtgagtaacacgtggggaacctgcccataagcaggggataacacttggaaacaggtgctaataccgtataacaatgtaaaccgcatggtttacatttgaaagatggtttcggctatcacttatggatggacccgcggcgcattagctagttggtgaggtaacggctcaccaaggcaatgatgcgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttggagaagaacatggatgagagtaactgttcatttattgacggtatccaaccagaaagccacggctaactacgtgccagcagccgcggtaatacgtaggtggcaagcgttgtccggatttattgggcgtaaagcgagcgcaggcggtcttttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgcaacgcgaagaaccttaccaggtcttgacatcttctgctaacccaagagattgggcgttcccttcggggacggaatgacaggtggtgcatggctgtcgtcagctcgtgtcgtgagatgttgggttaagtcccgcaacgagcgcaacccttattgttagttgccagcatttagttgggcactctagcaagactgccggtgacaaaccggaggaaggtggggatgacgtcaagtcctcatgccccttatgacctgggctacacacgtgctacaatggacggtacaacgagtcgcgaaaccgcgaggtcaagctaatctcttaaagccgttctcagttcggattgcaggctgcaactcgcctgcatgaagtcggaatcgctagtaatcgtggatcagcatgccacggtgaatacgttcccgggccttgtacacaccgcccgtcacaccatgagagtttgtaacacccaaagccggtggggtaaccttttaggagccagccgtctaaggtgggacagatgattagggtgaagtcgtaacaaggtagccgtaggagaacctgcggctggatcacctcctttctaaggaa

SEQ ID NO: 4786 - DNA, 1575 bp, Lactobacillus senmaizukei
  ref <308>: DATABASE ACCESSION NUMBER: NCBI ACCESSION: NZ_BCWD01000055.1
  ref <309>: DATABASE ENTRY DATE: 2019-04-01
  ref <313>: RELEVANT RESIDUES IN SEQ ID NO: (1)..(1575)
ataagatgagagtttgatcctggctcaggacgaacgctggcggcatgcctaatacatgcaagtcgaacgagcttccgttgattgaagtgcttgcactgatttcaacactgaagcgagtggcgaactggtgagtaacacgtgggtaacttgcccagaagcaggggataacacttggaaacaggtgctaataccgtataacaacagaaaccgcatggtttctgtttgaaagatggtttcggctatcacttctggatggacccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacactcttgagagtaactgttcaggagttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatcttagagataagacgttcccttcggggacagaatgacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagttgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4787 - DNA, 1475 bp, Lactobacillus sharpeae
  ref <308>: DATABASE ACCESSION NUMBER: NCBI ACCESSION: NZ_AYYO01000031.1
  ref <309>: DATABASE ENTRY DATE: 2019-04-01
  ref <313>: RELEVANT RESIDUES IN SEQ ID NO: (1)..(1475)
ttaagagcggtgagtggcggatgggtgagtaacacgtgggtaacctgccttctagcaggggataacatctggaaacaggtgctaataccgtataaatcgtcaaaccgcatggtttgacgctgaaaggcggcttcggctgtcactagaagatggacccgcggtgcattagttagttggtgaggtaaaggcccaccaagaccgtgatgcatagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaagctctgttgttgaagaagaacactagtgagagtaactgttcattagttgacggtattcaaccagaaagccacggctaactacgtgccagcagccgcggtaatacgtaggtggcgagcgttatccggatttattgggcgtaaagcgagcgcaggcggtttcttaagtctgatgtgaaagcccccggctcaaccggggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatactaagtgttggagggtttccgcccttcagtgctgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggacgacgtcaaatcatcatgccccttatgacctgggctacacacgtgctacaatggccggtacaacgagtcgccaacccgcgagggtgcgctaatctcttaaagccggtctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccgaagccggtggggtaaccctttcgagggagctagccgtctaaggtgggacagatgattagggtgaagtcgtaacaaggtagccgtaggagaacctgcggctggatcacctcctttctaagga

SEQ ID NO: 4788 - DNA, 1502 bp, Lactobacillus shenzhenensis
  ref <308>: DATABASE ACCESSION NUMBER: NCBI ACCESSION: NZ_KI271633.1
  ref <309>: DATABASE ENTRY DATE: 2019-04-01
  ref <313>: RELEVANT RESIDUES IN SEQ ID NO: (1)..(1502)
agttcgcggtggtgcttgcactaccaactacagataacaccgagtggcggacgggtgagtaacacgtgggtaacctgccctttagctggggataacatttggaaacagatgctaataccgaataaccacggagaccgcatggtctccgggtaaaaggcggcgtaagctgtcactaaaggatggacccgcggcgtattagccagttggtgaggtaacggcccaccaaagcaatgatacgtagccgacctgagagggtaatcggccacattgggactgagacacggcccaaactcctacgggaggcagcagtagggaatcttccacaatggacgcaagtctgatggagcaacgccgcgtgagtgaagaaggctttcgggtcgtaaaactctgttattgaagaagaacgtgtgggatagtaactgatctcgcagtgacggtattcaatcagaaagtcacggctaactacgtgccagcagccgcggtaatacgtaggtggcaagcgttgtccggatttattgggcgtaaagcgagtgcaggcggtcttttaagtctgatgtgaaagccttcggcttaaccgaagaagggcatcggaaactgggagacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgaatactaagtgttggagggtttccgcccttcagtgctgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgccaggctgagagatcagctgttcccttcggggacagaatgacaggtggtgcatggttgtcgtcagctcgtgtcgtgagatgttgggttaagtcccgcaacgagcgcaacccttatgttcagttgccagcattcagttgggcactctggacagactgccggtgacaaaccggaggaaggcggggatgacgtcaaatcatcatgccccttatgacctgggctacacacgtgctacaatgggtggtacaacgagcagcgagaccgcgaggtcaagcgaatctctaaaaaccatcctcagttcggattgcaggctgcaactcgcctgcatgaagctggaatcgctagtaatcgcggatcagcacgccgcggtgaatacgttcccgggccttgtacacaccgcccgtcacaccatgagagtttgtaacacccaaagccggtgggacaaccgtaaggagtcagccgtctaaggtgggacaaatgattagggtgaagtcgtaacaaggtagccgtaggagaacctgcggctggatcacctcctttctaaggaa

SEQ ID NO: 4789 - DNA, 604 bp, Lactobacillus silagei
  ref <308>: DATABASE ACCESSION NUMBER: NCBI ACCESSION: NZ_BCMG01000031.1
  ref <309>: DATABASE ENTRY DATE: 2019-04-01
  ref <313>: RELEVANT RESIDUES IN SEQ ID NO: (1)..(604)
ggtaatcggccacattgggactgagatacggcccaaactcctacgggaggcagcagtagggaatcttccacaatggacgaaagtctgatggagcaacgccgcgtgagtgaagaagggtttcggctcgtaaaactctgttgttgaagaagaacacatctgagagtaactgttcaggtgttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatactaggtgttggagggtttccgcccttcagtgccgcagctaacgcattaagtattccgcctggggagtacgaccgcaaggt

SEQ ID NO: 4790 - DNA, 991 bp, Lactobacillus silagincola
  ref <308>: DATABASE ACCESSION NUMBER: NCBI ACCESSION: NZ_BCMJ01000021.1
  ref <309>: DATABASE ENTRY DATE: 2019-04-01
  ref <313>: RELEVANT RESIDUES IN SEQ ID NO: (1)..(991)
acaactgaaaccgcatggtttcagtttgaaagatggtttcggctatcacttctggatggacccgcggcgtattagctagttggtggagtaatggttcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttgaagaagaacacatctgagagtaactgttcaggtgttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatactaggtgttggagggtttccgcccttcagtgccgcagctaacgcattaagtattccgcctggggagtacgaccgcaaggttgaaactcaaaggaattgacgggggcccgcacaagcggtggagcatgtggtttaattcgaagctacgcgaagaaccttaccaggtcttgacatactgtgctaacctaagagattaggcgttcccttcggggacgcagatacaggtggtgcatggctgtcgtcagctcgtgtcgtgagatgttgggttaagtcccgcaacgagcgcaacccttattgtcagttgccagcatttagttgggcactctggcgagactgccg

SEQ ID NO: 4791 - DNA, 1584 bp, Lactobacillus siliginis
  ref <308>: DATABASE ACCESSION NUMBER: NCBI ACCESSION: NZ_JQCB01000034.1
  ref <309>: DATABASE ENTRY DATE: 2019-04-01
  ref <313>: RELEVANT RESIDUES IN SEQ ID NO: (1)..(1584)
ttaatttgagagtttgatcctggctcaggatgaacgctggcggcgtgcctaatacatgcaagtcgaacgcatcttcgttttagattgatagtgcttgcactggattgataagacatttagatgagtggcgaacgggtgagtaacacgtgggtaacctgccctaaagagggggataacatttggaaacagatgctaataccgcataacaacgaaaaccacatggttttcgcttgaaagatggtttcggctatcactttaggatggacccgcggtgcattagctagatggtgaggtaaaggctcaccatggcaatgatgcatagccgagctgagaggctgatcggccacattgggactgagacacggcccagactcctacgggaggcagcagtagggaatcttccacaatgggcgaaagcctgatggagcaacgccgcgtgagtgaagaagggtttcggctcgtaaaactctgttgttaaagaagaacgtatctgatagtaactgatcaggtagtgacggtatttaaccagaaagccacggctaactacgtgccagcagccgcggtaatacgtaggtggcaagcgttatccggatttattgggcgtaaagggagtgcaggcggttatttaagtctgatgtgaaagccttcggcttaaccggagaagggcatcggaaactggataacttgagtacagaagagggtagtggaactccatgtgtagcggtggaatgcgtagatatatggaagaacaccagtggcgaaggcggctacctggtctgtaactgacgctgaggctcgaaagcatgggtagcaaacaggattagataccctggtagtccatgccgtaaacgatgaatactaggtgttagggggtttccgccccttagtgccgcagctaacgcaataagtattccgcctggggagtacgaccgcaaggttgaaactcaaaggaattgacggggacccgcacaagcggtggagcatgtggtttaattcgaagctacgcgaagaaccttaccagggcttgacatcttctgctaatccgagagatcggacgttcccttcggggacggaaagacaggtggtgcatggttgtcgtcagctcgtgtcgtgagatgttgggttaagtcccgcaacgagcgcaacccttatgattagttgccagcattaagttgggcactctaatgagactgccggtgacaaaccggaggaaggtggggacgacgtcaaatcatcatgccccttatgtcctgggctacacacgtgctacaatggatggtacaacgagcagcgaagtcgcgaggccaagcaaatctcttaaagccattctcagttcggactgtaggctgcaactcgcctacacgaagtcggaatcgctagtaatcgcggatcagcatgccgcggtgaatacgttcccgggtcttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttctaaggaa

SEQ ID NO: 4792 - DNA, 1360 bp, Lactobacillus similis
  ref <308>: DATABASE ACCESSION NUMBER: NCBI ACCESSION: NZ_AYZM01000074.1
  ref <309>: DATABASE ENTRY DATE: 2019-04-01
  ref <313>: RELEVANT RESIDUES IN SEQ ID NO: (1)..(1360)
tttctgtttgaaagatggtttcggctatcacttctggatggacccgcggcgtattagctagttggtggagtaatggttcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttgaagaagaacacacctgagagtaactgttcaggtgttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagctacgcgaagaaccttaccaggtcttgacatactgtgctaacctaagagattaggcgttcccttcggggacgcagatacaggtggtgcatggctgtcgtcagctcgtgtcgtgagatgttgggttaagtcccgcaacgagcgcaacccttattgtcagttgccagcattcagttgggcactctggcgagactgccggtgacaaaccggaggaaggtggggatgacgtcaagtcatcatgccccttatgacctgggctacacacgtgctacaatggatggtacaacgagttgcgaactcgcgagagtaagctaatctcttaaagccattctcagttcggactgcaggctgcaactcgcctgcacgaagtcggaatcgctagtaatcgcggatcagcatgccgcggtgaatacgttcccgggccttgtacacaccgcccgtcacaccatgagagtttgcaacacccaaagtcgattcggtaaccttcgggagcctgtcgcctaaggtggggcagatgattagggtgaagtcgtaacaaggtagccgtaggagaacctgcggctggatcacctcctttctaaggaa

SEQ ID NO: 4793 - DNA, 1580 bp, Lactobacillus songhuajiangensis
  ref <308>: DATABASE ACCESSION NUMBER: NCBI ACCESSION: NZ_RHNR01000086.1
  ref <309>: DATABASE ENTRY DATE: 2019-04-01
  ref <313>: RELEVANT RESIDUES IN SEQ ID NO: (1)..(1580)
taatttgagagtttgatcctggctcaggatgaacgctggcggcgtgcctaatacatgcaagtcgagcgaacttaacttaatgattgaagtgcttgcactgattgacttaagagcggtgagcggcggatgggtgagtaacacgtgggtaacctgcccttaagtgggggataacatttggaaacagatgctaataccgcataaatccccggaccacatggtctggggctgaaagaaggcttcggctttcacttaaggatggacccgcggcgcattagttagttggtgaggtaatggctcaccaagaccgtgatgcgtagccgacctgagagggtgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttgaagaagaacactagtgagagtaactgttcattagttgacggtattcaaccagaaagccacggctaactacgtgccagcagccgcggtaatacgtaggtggcaagcgttatccggatttattgggcgtaaagcgagcgcaggcggtttcttaagtctgatgtgaaagcccccggctcaaccggggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatactaggtgttggagggtttccgcccttcagtgccgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgccaatctgagagatcagacgttcccttcggggacagaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggacgacgtcaaatcatcatgccccttatgacctgggctacacacgtgctacaatggccggtacaacgagtcgccaacccgcgagggtgcgctaatctcttaaagccggtctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggggcaacccttttagggagctagccgtctaaggtgggacagatgattagggtgaagtcgtaacaaggtagccgtaggagaacctgcggctggatcacctcctttctaagga

SEQ ID NO: 4794 - DNA, 1575 bp, Lactobacillus sp. 112-3
  ref <308>: DATABASE ACCESSION NUMBER: NCBI ACCESSION: NZ_RHNW01000029.1
  ref <309>: DATABASE ENTRY DATE: 2019-04-01
  ref <313>: RELEVANT RESIDUES IN SEQ ID NO: (1)..(1575)
ttaagatgagagtttgatcctggctcaggacgaacgctggcggcatgcctaatacatgcaagtcgaacgagcttccgttgaatgacgtgcttgcactgattttaacattgaagcgagtggcgaactggtgagtaacacgtgggaaatctgcccagaagcaggggataacacttggaaacaggtgctaataccgtataacaacaagaaccgcatggttcttgtttgaaaggtggcttcggctatcacttctggatgatcccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacttctgagagtaactgttcagaagttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggtaacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4795 - DNA, 1583 bp, Lactobacillus sp. 116-2
  ref <308>: DATABASE ACCESSION NUMBER: NCBI ACCESSION: NZ_RHOR01000031.1
  ref <309>: DATABASE ENTRY DATE: 2019-04-01
  ref <313>: RELEVANT RESIDUES IN SEQ ID NO: (1)..(1583)
ttaatatgagagtttgatcctggctcaggacgaacgctggcggcgtgcctaatacatgcaagtcgagcgaactctggtaattgaacgatggtgcttgcaccggagtgattttacatttgagtgagcggcggatgggtgagtaacacgtgggtaacctgccctaaagtgggggataacatctggaaacaggtgctaataccgcataacaacatttaccacatggtttatgtttgaaagatggttttgctatcgctttaggatggacccgcggcgtattagctagttggtaaggtaatggcttaccaaggcagtgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcatgagagtaactgttcatgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggaaagtggaactccatgtgtagcggtggaatgcgtagatatatggaagaacaccagtggcgaaggcggctttctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgcaggctgcaactcgcctgcatgaagctggaatcgctagtaatcgtggatcagcatgccacggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaaggaa

SEQ ID NO: 4796 - DNA, 1574 bp, Lactobacillus sp. 137-3
  ref <308>: DATABASE ACCESSION NUMBER: NCBI ACCESSION: NZ_RHOA01000027.1
  ref <309>: DATABASE ENTRY DATE: 2019-04-01
  ref <313>: RELEVANT RESIDUES IN SEQ ID NO: (1)..(1574)
taagatgagagtttgatcctggctcaggacgaacgctggcggcatgcctaatacatgcaagtcgaacgagcttccgttgaatgacgtgcttgcactgatttcaacattgaagcgagtggcgaactggtgagtaacacgtgggtaacttgcccagaagagggggataacacttggaaacaggtgctaataccgcataacaacagaaaccgcatggtttctgtttgaaagatggtttcggctatcacttctggatggacccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacactcttgagagtaactgttcaggagttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4797 - DNA, 1581 bp, Lactobacillus sp. 143-1
  ref <308>: DATABASE ACCESSION NUMBER: NCBI ACCESSION: NZ_RHOT01000062.1
  ref <309>: DATABASE ENTRY DATE: 2019-04-01
  ref <313>: RELEVANT RESIDUES IN SEQ ID NO: (1)..(1581)
ttatatgagagtttgatcctggctcaggatgaacgctggcggcgtgcctaatacatgcaagtcgaacgagtttcgatttgatcagaagatgcttgcattggaagagataatcaaaacgagtggcggacgggtgagtaacacgtgggtaacctaccctttagtgggggataacatttggaaacagatgctaataccgcataacaataaaaaccacatggtttttatttgaaagatggttttgctatcgcttaaggatggacccgcggcgtattagttagttggtgaggtaacggctcaccaagacgatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtacttggtagtaactggccaggtagtgacggtatctaaccagaaagccacggctaactacgtgccagcagccgcggtaatacgtaggtggcaagcgttatccggatttattgggcgtaaagcgagtgcaggcggttttttaagtctgatgtgaaagccttcggcttaaccgaagaaatgcattggaaactggggaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcttagagataagacgttcccttcggggacgctaagacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggctgatacaacgagttgcgagaccgcgaggtcaagctaatctctaaaagtcagtctcagttcggattgtaggctgcaactcgcctacatgaagttggaatcgctagtaatcgcggatcagcacgccgcggtgaatacgttcccgggccttgtacacaccgcccgtcacaccatgagagtttgtaacacccaaagccggtgcggtaacctatttataggagctagccgtctaaggtgggacagatgattagggtgaagtcgtaacaaggtagccgtaggagaacctgcggctggatcacctcctttctaaggaa

SEQ ID NO: 4798 - DNA, 1575 bp, Lactobacillus sp. 143-4 a
  ref <308>: DATABASE ACCESSION NUMBER: NCBI ACCESSION: NZ_RHOH01000023.1
  ref <309>: DATABASE ENTRY DATE: 2019-04-01
  ref <313>: RELEVANT RESIDUES IN SEQ ID NO: (1)..(1575)
ttatatgagagtttgatcctggctcaggatgaacgctggcggcgtgcctaatacatgcaagtcgaacgaggtttaatggattgagttcttcggaataatttcttttgaaccgagtggcggacgggtgagtaacacgtgggtaacctgccctcaagcaggggataacatttggaaacagatgctaataccgtataatcccagagaccgcatggtctctggttgaaaggcggctttcgagctgtcacttgaggatggacccgcggcgcattagctagttggtgaggtaaaggcccaccaaggcagtgatgcgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaaactctgttgttggagaagaacgtgtgtgagagtaactgttcatgcagtgacggtatccaaccagaaagccacggctaactacgtgccagcagccgcggtaatacgtaggtggcaagcgttatccggatttattgggcgtaaagcgagcgcaggcggtttcttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgaccatctgagagatcagattttcccttcggggacaaaatgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggacgacgtcaaatcatcatgccccttatgacctgggctacacacgtgctacaatggccggtacaacgagttgctaacccgcgagggtacgctaatctcttaaagccggtctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggggtaacccgtaagggagctagccgtctaaggtgggacagatgattagggtgaagtcgtaacaaggtagccgtaggagaacctgcggctggatcacctcctttctaagga

SEQ ID NO: 4799 - DNA, 1582 bp, Lactobacillus sp. 143-6
  ref <308>: DATABASE ACCESSION NUMBER: NCBI ACCESSION: NZ_RHOW01000072.1
  ref <309>: DATABASE ENTRY DATE: 2019-04-01
  ref <313>: RELEVANT RESIDUES IN SEQ ID NO: (1)..(1582)
ttatatgagagtttgatcctggctcaggacgaacgctggcggcgtgcctaatacatgcaagtcgaacgagttttgttttaaggatcaaggtgcttgcaccgagagaattagaatgaaacgagtggcggacgggtgagtaacacgtgggtaacctaccctaaagtgggggataacatttggaaacagatgctaataccgcataacgaacgaagccacatggctttgttctgaaagatggcgtaagctatcacttttggatggacccgcggcgtattagctagttggtgaggtaacggctcaccaaggcgatgatacgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaaactctgttatcggagaagaacgtacttggtagtaactggccaggtagtgacggtatccgatcagaaagccacggctaactacgtgccagcagccgcggtaatacgtaggtggcaagcgttgtccggatttattgggcgtaaagcgagtgcaggcggttttttaagtctgatgtgaaagccttcggcttaaccgaagaaatgcattggaaactggggaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggggggtttccgcccctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcttagagataagacgttcccttcggggacgctaagacaggtggtgcatggttgtcgtcagctcgtgtcgtgagatgttgggttaagtcccgcaacgagcgcaacccttatgattagttgccagcattcagttgggcactctagtcagactgccggtgacaaaccggaggaaggtggggatgacgtcaaatcatcatgccccttatgacctgggctacacacgtgctacaatggctagtacaacgagttgcgagaccgcgaggtcaagctaatctctaaaagctagtctcagttcggattgtaggctgcaactcgcctacatgaagttggaatcgctagtaatcgcggatcagcacgccgcggtgaatacgttcccgggccttgtacacaccgcccgtcacaccatgagagtttgtaacacccaaagccggtgaggtaacccgtaagggagctagccgtctaaggtgggacagatgattagggtgaagtcgtaacaaggtagccgtaggagaacctgcggctggatcacctcctttctaaggaa

SEQ ID NO: 4800 - DNA, 1574 bp, Lactobacillus sp. 151-2B
  ref <308>: DATABASE ACCESSION NUMBER: NCBI ACCESSION: NZ_RHOC01000027.1
  ref <309>: DATABASE ENTRY DATE: 2019-04-01
  ref <313>: RELEVANT RESIDUES IN SEQ ID NO: (1)..(1574)
taagatgagagtttgatcctggctcaggacgaacgctggcggcatgcctaatacatgcaagtcgaacgcgtcttcgttaactgaagtgcttgcacggacgttaaccataagacgagtggcgaactggtgagtaacacgtaggaaacctgcccagaagcaggggataacacttggaaacaggtgctaataccgtataacaacaaaaaccgcatggtttttgtttgaaagatggcttcggctatcacttctggatggtcctgcggcgtattagttagttggtgaggtaaaggcccaccaagacgatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttgaagaagaacgggtgcaagagtaactgtttgcatcgtgacggtattcaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactggggaacttgagtgcagaagaggacagtggaactccatgtgtagcggtggaatgcgtagatatatggaagaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatgggcggtacaacgagttgcgaagtcgtgaggctaagctaatctcttaaagccgctctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4801 - DNA, 1585 bp, Lactobacillus sp. 159-4
  ref <308>: DATABASE ACCESSION NUMBER: NCBI ACCESSION: NZ_RHOJ01000046.1
  ref <309>: DATABASE ENTRY DATE: 2019-04-01
  ref <313>: RELEVANT RESIDUES IN SEQ ID NO: (1)..(1585)
ttatatgagagtttgatcctggctcaggatgaacgctggcggcgtgcctaatacatgcaagtcgaacgaggttttgacaattgatcaaggtgcttgcaccgagagattttgttaacaccgagtggcggacgggtgagtaacacgtgggtaacctgcccttaagcgggggataacatttggaaacagatgctaataccgcataaacccaagaaccacatggttcttggttgaaaggcggctttcgagctgtcacttaaggatggacccgcggcgtattagctagttggtaaggtaacggcttaccaaggcgatgatacgtagccgaactgagaggttgatcggccacaatgggactgagacacggcccatactcctacgggaggcagcagtagggaatcttccacaatggacgcaagtctgatggagcaacgccgcgtgagtgaagaaggctttcgggtcgtaaaactctgttgttggagaagaacactagtgagagtaactgttcattagttgacggtatccaaccagaaagccacggctaactacgtgccagcagccgcggtaatacgtaggtggcaagcgttatccggatttattgggcgtaaagcgagcgcaggcggtttcttaagtctgatgtgaaagccttcggcttaaccgaagaagtgcatcggaaactggggaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgacgcaacgcgaagaaccttaccaggtcttgacatcctatgccaacctgagagatcaggcgttcccttcggggacatagtgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggacgacgtcaaatcatcatgccccttatgacctgggctacacacgtgctacaatggccggtacaacgagttgcgaacccgcgagggtaagctaatctcttaaagccggtctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccgaagccggtggggtaacctctatgaggagctagccgtctaaggtgggacagatgattagggtgaagtcgtaacaaggtagccgtaggagaacctgcggctggatcacctcctttctaaggaa

SEQ ID NO: 4802 - DNA, 1581 bp, Lactobacillus sp. 17-4
  ref <308>: DATABASE ACCESSION NUMBER: NCBI ACCESSION: NZ_RHOU01000029.1
  ref <309>: DATABASE ENTRY DATE: 2019-04-01
  ref <313>: RELEVANT RESIDUES IN SEQ ID NO: (1)..(1581)
ttatatgagagtttgatcctggctcaggatgaacgctggcggcgtgcctaatacatgcaagtcgaacgagtttcgatttgatcagaagatgcttgcattggaagagataatcaaaacgagtggcggacgggtgagtaacacgtgggtaacctaccctttagtgggggataacatttggaaacagatgctaataccgcataacaataaaaaccacatggtttttatttgaaagatggttttgctatcgcttaaggatggacccgcggcgtattagttagttggtgaggtaacggctcaccaagacgatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtacttggtagtaactggccaggtagtgacggtatctaaccagaaagccacggctaactacgtgccagcagccgcggtaatacgtaggtggcaagcgttatccggatttattgggcgtaaagcgagtgcaggcggtttcttaagtctgatgtgaaagccttcggcttaaccgaagaaatgcattggaaactggggaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcttagagataagacgttcccttcggggacgctaagacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggctgatacaacgagttgcgagaccgcgaggtcaagctaatctctaaaagtcagtctcagttcggattgtaggctgcaactcgcctacatgaagttggaatcgctagtaatcgcggatcagcacgccgcggtgaatacgttcccgggccttgtacacaccgcccgtcacaccatgagagtttgtaacacccaaagccggtgcggtaacctatttataggagctagccgtctaaggtgggacagatgattagggtgaagtcgtaacaaggtagccgtaggagaacctgcggctggatcacctcctttctaaggaa

SEQ ID NO: 4803 - DNA, 1583 bp, Lactobacillus sp. 184-8
  ref <308>: DATABASE ACCESSION NUMBER: NCBI ACCESSION: NZ_RHOQ01000015.1
  ref <309>: DATABASE ENTRY DATE: 2019-04-01
  ref <313>: RELEVANT RESIDUES IN SEQ ID NO: (1)..(1583)
ttaatatgagagtttgatcctggctcaggacgaacgctggcggcgtgcctaatacatgcaagtcgagcgaactctggtaactgaacgatggtgcttgcaccggagtgatgatacatttgagtgagcggcggatgggtgagtaacacgtgggtaacctgccctaaagtgggggataacatctggaaacaggtgctaataccgcataacaacatttaccacatggtttatgtttgaaagatggttctgctatcgctttaggatggacccgcggcgtattagctagttggtgaggtaacggctcaccaaggcagtgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcatgagagtaactgttcatgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggaaagtggaactccatgtgtagcggtggaatgcgtagatatatggaagaacaccagtggcgaaggcggctttctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgcaggctgcaactcgcctgcatgaagctggaatcgctagtaatcgtggatcagcatgccacggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaaggaa

SEQ ID NO: 4804 - DNA, 1578 bp, Lactobacillus sp. 187-3
  ref <308>: DATABASE ACCESSION NUMBER: NCBI ACCESSION: NZ_RHOE01000102.1
  ref <309>: DATABASE ENTRY DATE: 2019-04-01
  ref <313>: RELEVANT RESIDUES IN SEQ ID NO: (1)..(1578)
tttatatgagagtttgatcctggctcaggatgaacgctggcggcgtgcctaatacatgcaagtcgaacgcactgacgtcgactgaagctgcttgcagtggaagtcgatcgacgtgagtggcggacgggtgagtaacacgtgggtaacctacccttaagtgggggataacatttggaaacagatgctaataccgcataaccatacagaccacatggtctgtatgtaaaagatggcttcggctatcacttttggacggacccgcggcgtattagttagttggtaaggtaacggcttaccaagacgatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttggagaagaacagggactagagtaactgttagtcctttgacggtatccaaccagaaagccacggctaactacgtgccagcagccgcggtaatacgtaggtggcaagcgttatccggatttattgggcgtaaagcgagcgcaggcggttttttaagtctgatgtgaaagccttcggcttaaccgaagaagtgcattagaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatggggagcgaacaggattagataccctggtagtccataccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcctttgaccactgtagagatacagctttcccttcggggacaaagtgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcagcatgccccttatgacctgggctacacacgtgctacaatggtcggtacaacgagttgcgaacccgcgagggtaagctaatctcttaaagccgatctcagttcggattgtaggctgcaactcgcctacatgaagccggaatcgctagtaatcgcggatcagcacgccgcggtgaatacgttcccgggccttgtacacaccgcccgtcacaccatgagagtttgtaacacccgaagtcggtggggtaacccttttagggaactagccgcctaaggtgggacagatgattggggtgaagtcgtaacaaggtagccgtaggagaacctgcggctggatcacctcctttctaaggaa

SEQ ID NO: 4805 - DNA, 1583 bp, Lactobacillus sp. 204-8
  ref <308>: DATABASE ACCESSION NUMBER: NCBI ACCESSION: NZ_RHOP01000034.1
  ref <309>: DATABASE ENTRY DATE: 2019-04-01
  ref <313>: RELEVANT RESIDUES IN SEQ ID NO: (1)..(1583)
ttaatatgagagtttgatcctggctcaggacgaacgctggcggcgtgcctaatacatgcaagtcgagcgaactctggtttttgaacgatggtgcttgcaccggagtgattaaacatttgagtgagcggcggatgggtgagtaacacgtgggtaacctgccctaaagtgggggataacatctggaaacaggtgctaataccgcataacaacatttaccacatggtttatgtttgaaagatggttctgctatcgctttaggatggacccgcggtgcattagttagttggtgaggtaacggctcaccaagaccgtgatgcatagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcacgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggagagtggaactccatgtgtagcggtggaatgcgtagatatatggaagaacaccagtggcgaaggcggctctctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaaggaa

SEQ ID NO: 4806 - DNA, 1574 bp, Lactobacillus sp. 218-10
  ref <308>: DATABASE ACCESSION NUMBER: NCBI ACCESSION: NZ_RHNY01000035.1
  ref <309>: DATABASE ENTRY DATE: 2019-04-01
  ref <313>: RELEVANT RESIDUES IN SEQ ID NO: (1)..(1574)
taagatgagagtttgatcctggctcaggacgaacgctggcggcatgcctaatacatgcaagtcgaacgagcttccgttgattgacgtgcttgcactgatttcaacattgaagcgagtggcgaactggtgagtaacacgtgggaaatctgcccagaagcaggggataacacttggaaacaggtgctaataccgtataacaacaaaaaccgcatggtttttgtttgaaagatggtttcggctatcacttttggatgatcccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacttctgagagtaactgttcagaagttgacggtatttaaccagaaagccacggctaactacgtgccagcagccgcggtaatacgtaggtggcaagcgttgtccggatttattgggcgtaaagcgagcgcaggcggtcttttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcttagagataagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4807 - DNA, 1574 bp, Lactobacillus sp. 218-6
  ref <308>: DATABASE ACCESSION NUMBER: NCBI ACCESSION: NZ_RHNX01000068.1
  ref <309>: DATABASE ENTRY DATE: 2019-04-01
  ref <313>: RELEVANT RESIDUES IN SEQ ID NO: (1)..(1574)
taagatgagagtttgatcctggctcaggacgaacgctggcggcatgcctaatacatgcaagtcgaacgagcttccgttgattgaggtgcttgcactgatttcaacaccgaagcgagtggcgaactggtgagtaacacgtgggaaatctgcccagaagcaggggataacacttggaaacaggtgctaataccgcataacaacaagaaccgcatggttcttgtttgaaaggtggcttcggctatcacttctggatgatcccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacactcttgagagtaactgttcaggagttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggaaacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaacctaagagattaggcgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4808 - DNA, 1574 bp, Lactobacillus sp. 220-4
  ref <308>: DATABASE ACCESSION NUMBER: NCBI ACCESSION: NZ_RHOD01000051.1
  ref <309>: DATABASE ENTRY DATE: 2019-04-01
  ref <313>: RELEVANT RESIDUES IN SEQ ID NO: (1)..(1574)
taagatgagagtttgatcctggctcaggacgaacgctggcggcatgcctaatacatgcaagtcgaacgcgtcttcgttaactgaagtgcttgcacggacgttaaccataagacgagtggcgaactggtgagtaacacgtaggaaacctgcccagaagcaggggataacacttggaaacaggtgctaataccgtataacaacgaaaaccgcatggttttcgtttgaaagatggcttcggctatcacttctggatggtcctgcggcgtattagttagttggtgaggtaaaggcccaccaagacgatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttgaagaagaacgggtgcaagagtaactgtttgcatcgtgacggtattcaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactggggaacttgagtgcagaagaggacagtggaactccatgtgtagcggtggaatgcgtagatatatggaagaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatgggcggtacaacgagttgcgaagtcgtgaggctaagctaatctcttaaagccgctctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4809 - DNA, 1575 bp, Lactobacillus sp. 244-4
  ref <308>: DATABASE ACCESSION NUMBER: NCBI ACCESSION: NZ_RHNZ01000038.1
  ref <309>: DATABASE ENTRY DATE: 2019-04-01
  ref <313>: RELEVANT RESIDUES IN SEQ ID NO: (1)..(1575)
ttaagatgagagtttgatcctggctcaggacgaacgctggcggcatgcctaatacatgcaagtcgaacgagcttccgttgaatgacgtgcttgcactgatttcaacaatgaagcgagtggcgaactggtgagtaacacgtgggtaacttgcccagaagcaggggataacacttggaaacaggtgctaataccgtataacaacagaaaccgcatggtttctgtttaaaaggtggtttcggctatcacttctggatggacccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacttctgagagtaactgttcagaagttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcaaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcctagagataggacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4810 - DNA, 1573 bp, Lactobacillus sp. 247-3
  ref <308>: DATABASE ACCESSION NUMBER: NCBI ACCESSION: NZ_RHOK01000048.1
  ref <309>: DATABASE ENTRY DATE: 2019-04-01
  ref <313>: RELEVANT RESIDUES IN SEQ ID NO: (1)..(1573)
ttatatgagagtttgatcctggctcaggatgaacgctggcggcgtgcctaatacatgcaagtcgaacgaggttttgttgatcgagttcttcggaacaacttctttaaaaccgagtggcggacgggtgagtaacacgtgggtaacctgcccttaagtgggggataacatttggaaacagatgctaataccgcataaacctttagaccacatggtctaaagttgaaagatggcgtaagctatcgcttttggatggacccgcggcgtattagctagttggtaaggtaacggcttaccaaggcgatgatacgtagccgaactgagaggttgatcggccacaatgggactgagacacggcccatactcctacgggaggcagcagtagggaatcttccacaatggacgcaagtctgatggagcaacgccgcgtgagtgaagaaggctttcgggtcgtaaaactctgttgttggagaagaacacgtttgagagtaactgttcagacgttgacggtatccaaccagaaagccacggctaactacgtgccagcagccgcggtaatacgtaggtggcaagcgttatccggatttattgggcgtaaagcgagcgcaggcggttttttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgacgcaacgcgaagaaccttaccaggtcttgacatcctatgccaacctgagagatcaggcgttcccttcggggacatagtgacaggtggtgcatggttgtcgtcagctcgtgtcgtgagatgttgggttaagtcccgcaacgagcgcaacccttatgactagttgccagcattaagttgggcactctagtaagactgccggtgacaaaccggaggaaggtggggacgacgtcaaatcatcatgccccttatgacctgggctacacacgtgctacaatggccggtacaacgagttgcgaacccgcgagggcaagctaatctcttaaagccggtctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccgaagccggtggggtaacctttcgaggagctagccgtctaaggtgggacagatgattagggtgaagtcgtaacaaggtagccgtaggagaacctgcggctggatcacctcctttctaagga

SEQ ID NO: 4811 - DNA, 1351 bp, Lactobacillus sp. 247-4
  ref <308>: DATABASE ACCESSION NUMBER: NCBI ACCESSION: NZ_RHOV01000049.1
  ref <309>: DATABASE ENTRY DATE: 2019-04-01
  ref <313>: RELEVANT RESIDUES IN SEQ ID NO: (1)..(1351)
aaagatggtttcggctatcacttttggatggacccgcggcgtattagttagttggtgaggtaacggctcaccaagacattgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttattggagaagaacgtacttggtagtaactggccaggtagtgacggtatccaaccagaaagccacggctaactacgtgccagcagccgcggtaatacgtaggtggcaagcgttatccggatttattgggcgtaaagcgagtgcaggcggtttcttaagtctgatgtgaaagccttcggcttaaccgaagaaatgcattggaaactggggaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcttagagataagacgttcccttcggggacgctaagacaggtggtgcatggttgtcgtcagctcgtgtcgtgagatgttgggttaagtcccgcaacgagcgcaacccttatgattagttgccagcattcagttgggcactctagtcagactgccggtgacaaaccggaggaaggtggggatgacgtcaaatcatcatgccccttatgacctgggctacacacgtgctacaatggctgatacaacgagttgcgagaccgcgaggtcaagctaatctctaaaagtcagtctcagttcggattgtaggctgcaactcgcctacatgaagttggaatcgctagtaatcgcggatcagcacgccgcggtgaatacgttcccgggccttgtacacaccgcccgtcacaccatgagagtttgtaacacccaaagccggtgaggtaaccttttaggagccagccgtctaaggtgggacagatgattagggtgaagtcgtaacaaggtagccgtaggagaacctgcggctggatcacctcctttctaaggaa

SEQ ID NO: 4812 - DNA, 1583 bp, Lactobacillus sp. 256-3
  ref <308>: DATABASE ACCESSION NUMBER: NCBI ACCESSION: NZ_RHON01000022.1
  ref <309>: DATABASE ENTRY DATE: 2019-04-01
  ref <313>: RELEVANT RESIDUES IN SEQ ID NO: (1)..(1583)
aaaatatgagagtttgatcctggctcaggatgaacgctggcggcgtgcctaatacatgcaagtcgagcgaactctggtaaatgaatgaaggtgcttgcacctgagtgattttacatttgagtgagcggcggatgggtgagtaacacgtgggtaacctgccctaaagtgggggataacatctggaaacaggtgctaataccgcataacaacaattttcacatgattattgtttgaaagatggttctgctatcgctttaggatggacccgcggcgtattagttagttggtgaggtaacggctcaccaagacgatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcatgagagtaactgttcatgtattgacggtattcaaccagaaagccacggctaactacgtgccagcagccgcggtaatacgtaggtggcaagcgttatccggatttattgggcgtaaagcgagtgcaggcggtttattaggtctgatgtgaaagccctcggctcaaccgaggaagtgcatcggaaaccggtaaacttgagtgcagaagaggagagtggaactccatgtgtagcggtggaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggggggtttccgcccctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattattagttgccagcattaagttgggcactctagtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaaggaa

SEQ ID NO: 4813 - DNA, 1578 bp, Lactobacillus sp. 257-1
  ref <308>: DATABASE ACCESSION NUMBER: NCBI ACCESSION: NZ_RHOF01000012.1
  ref <309>: DATABASE ENTRY DATE: 2019-04-01
  ref <313>: RELEVANT RESIDUES IN SEQ ID NO: (1)..(1578)
tttatatgagagtttgatcctggctcaggatgaacgctggcggcgtgcctaatacatgcaagtcgaacgcactgacgtcgaccgaagctgcttgcagtggacgttgattgacgtgagtggcggacgggtgagtaacacgtgggtaacctacccttaagtgggggataacatttggaaacagatgctaataccgcataaccatttagaccacatggtctgaatgtaaaagacggcctttggctgtcacttttggacggacccgcggcgtattagttagttggtaaggtaacggcttaccaagacgatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttaggctcgtaaaactctgttgttggagaagaacagggactagagtaactgttagtcctttgacggtatccaaccagaaagccacggctaactacgtgccagcagccgcggtaatacgtaggtggcaagcgttatccggatttattgggcgtaaagcgagcgcaggcggttttttaagtctgatgtgaaagccttcggcttaaccgaagaagtgcattagaaactggaaaacttgagtgcagaagaggacagtggaactccatgtgtagcggtgaaatgcgtagatatatggaagaacaccagtggcgaaggcggctgtctggtctgtaactgacgctgaggctcgaaagtatggggagcgaacaggattagataccctggtagtccataccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcctttgatcgctgtagagatacagttttcccttcggggacaaagtgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcagcatgccccttatgacctgggctacacacgtgctacaatggtcggtacaacgagttgcgaacccgcgagggtaagctaatctcttaaagccgatctcagttcggattgtaggctgcaactcgcctacatgaagccggaatcgctagtaatcgcggatcagcacgccgcggtgaatacgttcccgggccttgtacacaccgcccgtcacaccatgagagtttgtaacacccgaagtcggtggggtaacccttttagggaactagccgcctaaggtgggacagatgattggggtgaagtcgtaacaaggtagccgtaggagaacctgcggctggatcacctcctttctaagga

SEQ ID NO: 4814 - DNA, 1582 bp, Lactobacillus sp. 33-1
  ref <308>: DATABASE ACCESSION NUMBER: NCBI ACCESSION: NZ_RHOG01000059.1
  ref <309>: DATABASE ENTRY DATE: 2019-04-01
  ref <313>: RELEVANT RESIDUES IN SEQ ID NO: (1)..(1582)
ttatatgagagtttgatcctggctcaggatgaacgctggcggcgtgcctaatacatgcaagtcgaacgaggtttcgacaagtgaatgacgtgcttgcactgaatgatcttgttgagaccgagtggcggacgggtgagtaacacgtgggtaacctgcccttaagtgggggataacatttggaaacagatgctaataccgcataaacccaaagatcacatgatctttggttgaaagatggcgtaagctatcgcttttggatggacccgcggcgtattagctagttggtaaggtaaaggcctaccaaggcaatgatacgtagccgacctgagagggtgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggtttcttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgaccacttgagagatcaagttttcccttcggggacaaaatgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggatgacgtcaaatcatcatgccccttatgacctgggctacacacgtgctacaatggccggtacaacgagttgcgaacccgcgagggcaagctaatctcttaaagccggtctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggagtaacccgtaagggagctagccgtctaaggtgggacagatgattagggtgaagtcgtaacaaggtagccgtaggagaacctgcggctggatcacctcctttctaaggaa

SEQ ID NO: 4815 - DNA, 1586 bp, Lactobacillus sp. 33-7
  ref <308>: DATABASE ACCESSION NUMBER: NCBI ACCESSION: NZ_RHOS01000035.1
  ref <309>: DATABASE ENTRY DATE: 2019-04-01
  ref <313>: RELEVANT RESIDUES IN SEQ ID NO: (1)..(1586)
ttaatatgagagtttgatcctggctcaggacgaacgctggcggcgtgcctaatacatgcaagtcgagcgaactctggtaattgaacgatggtgcttgcaccggagtgattttacatttgagtgagcggcggatgggtgagtaacacgtgggtaacctgccctaaagtgggggataacatctggaaacaggtgctaataccgcataacaacatttaccacatggtttatgtttgaaagatggttttgctatcgctttaggatggacccgcggcgtattagctagttggtaaggtaatggcttaccaaggcagtgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcatgagagtaactgttcatgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggaaagtggaactccatgtgtagcggtggaatgcgtagatatatggaagaacaccagtggcgaaggcggctttctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgcaggctgcaactcgcctgcatgaagctggaatcgctagtaatcgtggatcagcatgccacggtgaatacgttcccgggccttgtacacaccgcccgtcacaccatgagagtttgtaacacccaaagccggtggggtaaccttttattaggagctagccgtctaaggtgggacaaatgattagggtgaagtcgtaacaaggtagccgtaggagaacctgcggctggatcacctcctttctaaggaa

SEQ ID NO: 4816 - DNA, 1576 bp, Lactobacillus sp. 47-3
  ref <308>: DATABASE ACCESSION NUMBER: NCBI ACCESSION: NZ_RHOI01000060.1
  ref <309>: DATABASE ENTRY DATE: 2019-04-01
  ref <313>: RELEVANT RESIDUES IN SEQ ID NO: (1)..(1576)
ttatatgagagtttgatcctggctcaggatgaacgctggcggcgtgcctaatacatgcaagtcgaacgaggtattggtaattgaagtcttcggactgattttaccgcttaccgagtggcggacgggtgagtaacacgtgggtaacctgcccttaagtgggggataacatttggaaacagatgctaataccgcataaacctcagaaacacatgtttctgagttgaaaggcggctttcgagctgtcgcttttggatggacccgcggcgtattagctagttggtgaggtaaaggctcaccaaggcagtgatacgtagccgacctgagagggtgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaacacgtttgagagtaactgttcagacgttgacggtatccaaccagaaagccacggctaactacgtgccagcagccgcggtaatacgtaggtggcaagcgttatccggatttattgggcgtaaagcgagcgcaggcggttttttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcctatgccaatctgagagatcagacgttcccttcggggacatagtgacaggtggtgcatggttgtcgtcagctcgtgtcgtgagatgttgggttaagtcccgcaacgagcgcaacccttatgactagttgccagcattaagttgggcactctagtaagactgccggtgacaaaccggaggaaggtggggacgacgtcaaatcatcatgccccttatgacctgggctacacacgtgctacaatggatggtacaacgagttgcgaacccgcgagggcaagctaatctcttaaagccattctcagtccggactgtaggctgcaactcgcctacacgaagtcggaatcgctagtaatcgcggatcagcatgccgcggtgaatacgttcccgggccttgtacacaccgcccgtcacaccatgagagtttgtaacacccgaagccggtggggtaaccttttaggagctagccgtctaaggtgggacagatgattagggtgaagtcgtaacaaggtagccgtaggagaacctgcggctggatcacctcctttctaaggaa

SEQ ID NO: 4817 - DNA, 1568 bp, Lactobacillus sp. 54-2
  ref <308>: DATABASE ACCESSION NUMBER: NCBI ACCESSION: NZ_RHOY01000034.1
  ref <309>: DATABASE ENTRY DATE: 2019-04-01
  ref <313>: RELEVANT RESIDUES IN SEQ ID NO: (1)..(1568)
ttatttgagagtttgatcctggctcaggacgaacgctggcggcgtgcctaatacatgcaagtcgaacgagaatttcctaccgagtgcttgcactcatttggaaattcgagtggcggacgggtgagtaacacgtgggcaacctgccctgaagtgggggataacatttggaaacagatgctaataccgcataataatttggaccacatggtccgaatttgaaagatggtttcggctatcacttcaggatgggcccgcggcgtattagccagttggtgaggtaacggctcaccaaagcaatgatacgtagccgacctgagagggtgatcggccacactgggactgagacacggcccagactcctacgggaggcagcagtagggaatcttccacaatggacgaaagtctgatggagcaacgccgcgtgagtgaagaagggtttcggctcgtaaaactctgttatcggagaagaacaggagcaggagtaactatctgtttcttgacggtatccgaccagaaagccacggctaactacgtgccagcagccgcggtaatacgtaggtggcaagcgttgtccggatttattgggcgtaaagcgagcgcaggcggttttttaagtctgatgtgaaagccctcggcttaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtgtgggtagcaaacaggattagataccctggtagtccacaccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagcaacgcgaagaaccttaccaggtcttgacatcctttgctaacctgagagatcaggcgttcccttcggggacaaagtgacaggtggtgcatggttgtcgtcagctcgtgtcgtgagatgttgggttaagtcccgcaacgagcgcaacccttataattagttgccagcattcagttgggcactctagttagactgccggtgacaaaccggaggaaggtggggatgacgtcaaatcatcatgccccttatgacctgggctacacacgtgctacaatggatggtacaacgagtcgctagaccgcgaggtcatgctaatctcttaaaaccattctcagttcggattgcaggctgcaactcgcctgcatgaagctggaatcgctagtaatcgcggatcagcacgccgcggtgaatacgttcccgggccttgtacacaccgcccgtcacaccatgagagtctgtaacacccaaagtcggtagggtaaccttttggagccagccgcctaaggcgggacagatgattagggtgaagtcgtaacaaggtagccgtaggagaacctgcggctggatcacctcctttctaaggaa

SEQ ID NO: 4818 - DNA, 1580 bp, Lactobacillus sp. 54-5
  ref <308>: DATABASE ACCESSION NUMBER: NCBI ACCESSION: NZ_RHOX01000058.1
  ref <309>: DATABASE ENTRY DATE: 2019-04-01
  ref <313>: RELEVANT RESIDUES IN SEQ ID NO: (1)..(1580)
atatgagagtttgatcctggctcaggacgaacgctggcggcgtgcctaatacatgcaagtcgaacgagtttgtttttattgattgaggtgcttgcaccgaaagatttaaaaacaaacgagtggcggacgggtgagtaacacgtgggtaacctaccctaaagtgggggataacatttggaaacagatgctaataccgcataatattaaaaaccacatggtttttaattgaaagacggcgtaagctgtcacttatggatggacccgcggcgtattagctagttggtgaggtaacggctcaccaaggcgatgatacgtagccgacctgagagggtgatcggccacattgggactgagacacggcccaaactcctacgggaggcagcagtagggaatcttccacaatggacgaaagtctgatggagcaacgccgcgtgagtgaagaaggttttcggatcgtaaaactctgttattggagaagaacgtatttggtagtaactggccagatagtgacggtatccaatcagaaagccacggctaactacgtgccagcagccgcggtaatacgtaggtggcaagcgttgtccggatttattgggcgtaaagcgagtgcaggcggttttttaagtctgatgtgaaagccttcggcttaaccgaagaaatgcattggaaactggggaacttgagtgcagaagaggagagtggaactccatgtgtagcggtgaaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagcgccaatcctagagataggacgttcccttcggggacgctaagacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggctagtacaacgagttgcgagaccgcgaggtcaagctaatctctaaaagctagtctcagttcggattgtaggctgcaactcgcctacatgaagttggaatcgctagtaatcgcggatcagcacgccgcggtgaatacgttcccgggccttgtacacaccgcccgtcacaccatgagagtttgtaacacccgaagccggtggagtaacccgtaagggagctagccgtctaaggtgggacagatgattagggtgaagtcgtaacaaggtagccgtaggagaacctgcggctggatcacctcctttctaaggaa

SEQ ID NO: 4819 - DNA, 1582 bp, Lactobacillus sp. 73-4
  ref <308>: DATABASE ACCESSION NUMBER: NCBI ACCESSION: NZ_RHOL01000064.1
  ref <309>: DATABASE ENTRY DATE: 2019-04-01
  ref <313>: RELEVANT RESIDUES IN SEQ ID NO: (1)..(1582)
tttatatgagagtttgatcctggctcaggatgaacgctggcggcgtgcctaatacatgcaagtcgaacgaggttttgacgaatgaacgatgtgcttgcacggagtgattttgttaacaccgagtggcggacgggtgagtaacacgtgggtaacctgcccttaagtgggggataacatttggaaacagatgctaataccgcataaacccaaggatcacatggtctttggttgaaagatggcgcaagctatcgcttttggatggacccgcggcgtattagctagttggtaaggtaacggcctaccaaggcaatgatacgtagccgaactgagaggttgatcggccacaatgggactgagacacggcccatactcctacgggaggcagcagtagggaatcttccacaatggacgcaagtctgatggagcaacgccgcgtgagtgaagaaggctttcgggtcgtaaaactctgttgttggagaagaacacgtttgagagtaactgttcagacgttgacggtatccaaccagaaagccacggctaactacgtgccagcagccgcggtaatacgtaggtggcaagcgttatccggatttattgggcgtaaagcgagcgcaggcggtttcttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgacgcaacgcgaagaaccttaccaggtcttgacatcctatgccaacctgagagatcaggcgttcccttcggggacatagtgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggacgacgtcaaatcatcatgccccttatgacctgggctacacacgtgctacaatggccggtacaacgagttgcgaacccgcgagggtaagctaatctcttaaagccggtctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccgaagccggtggggtaacctttcgaggagctagccgtctaaggtgggacagatgattagggtgaagtcgtaacaaggtagccgtaggagaacctgcggctggatcacctcctttctaagga

SEQ ID NO: 4820 - DNA, 1582 bp, Lactobacillus sp. 8-1 1
  ref <308>: DATABASE ACCESSION NUMBER: NCBI ACCESSION: NZ_RHOO01000042.1
  ref <309>: DATABASE ENTRY DATE: 2019-04-01
  ref <313>: RELEVANT RESIDUES IN SEQ ID NO: (1)..(1582)
ttaatatgagagtttgatcctggctcaggacgaacgctggcggcgtgcctaatacatgcaagtcgagcgaactctggtttttgatttttggtgcttgcaccaaaatgataaaacatttgagtgagcggcggatgggtgagtaacacgtgggtaacctgccctaaagtgggggataacatttggaaacaagtgctaataccgcataacaacatttaccacatggtttatgtttgaaagatggttctgctatcgctttaggatggacccgcggtgcattagttagttggtgaggtaacggctcaccaagaccgtgatgcatagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcacgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggagagtggaactccatgtgtagcggtggaatgcgtagatatatggaagaacaccagtggcgaaggcggctctctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaacactaagagattagtttttcccttcggggacaagaatacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaagga

SEQ ID NO: 4821 - DNA, 1576 bp, Lactobacillus sp. ASF360
  ref <308>: DATABASE ACCESSION NUMBER: NCBI ACCESSION: NZ_KB822439.1
  ref <309>: DATABASE ENTRY DATE: 2019-04-01
  ref <313>: RELEVANT RESIDUES IN SEQ ID NO: (1)..(1576)
aaaaatgagagtttgatcctggctcaggacgaacgctggcggcgtgcctaatacatgcaagtcgagcgagctgaaccagcagattcacttcggtgatgacgctgggaacgcgagcggcggatgggtgagtaacacgtgggtaacctgccctaaagtctgggataccacttggaaacaggtgctaataccggataacaacaatagctgcatggctattgcttaaaaggcggcgaaagctgtcgctaaaggatggacccgcggtgcattagctagttggtaaggtaatggcttaccaaggcgacgatgcatagccgagttgagagactgatcggccacattgggactgagacacggcccaaactcctacgggaggcagcagtagggaatcttccacaatgggcgaaagcctgatggagcaacgccgcgtgagtgaagaaggttttcggatcgtaaagctctgttgttggtgaagaaggatagaggtagtaactggcccctatttgacggtaatcaaccagaaagtcacggctaactacgtgccagcagccgcggtaatacgtaggtggcaagcgttgtccggatttattgggcgtaaagcgagcgcaggcggaaagataagtctgatgtgaaagcccccggcttaaccgaggaattgcatcggaaactgtgtttcttgagtgcagaagaggagagtggaactccatgtgtagcggtggaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatcctaagagattaggagttcccttcggggacactaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcgagcctgcgaaggcaagcggatctcttaaagctgttctcagttcggactgcagtctgcaactcgactgcacgaagctggaatcgctagtaatcgcggatcagcacgccgcggtgaatacgttcccgggccttgtacacaccgcccgtcacaccatggaagtctgcaatgcccgaagccggtggcctaaccacttatgtggaaggagccgtctaaggcagggcagatgactggggtgaagtcgtaacaaggtagccgtaggagaacctgcggctggatcacctcctttctaaggaa

SEQ ID NO: 4822 - DNA, 1435 bp, Lactobacillus sp. ATCC 15578
  misc_feature (96)..(96): n is a, c, g, or t
  ref <308>: DATABASE ACCESSION NUMBER: NCBI ACCESSION: NZ_LGJA01000003.1
  ref <309>: DATABASE ENTRY DATE: 2019-04-01
  ref <313>: RELEVANT RESIDUES IN SEQ ID NO: (1)..(1435)
taatttgagagtttgatcctggctcaggacgaacgctggcggcgtgcctaatacatgcaagtcgaacgaactctggtattgattggtgcttgcatnggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctttctaaggaa

SEQ ID NO: 4823 - DNA, 460 bp, Lactobacillus sp. BCRC 12945
  ref <308>: DATABASE ACCESSION NUMBER: NCBI ACCESSION: NZ_QXIL01000002.1
  ref <309>: DATABASE ENTRY DATE: 2019-04-01
  ref <313>: RELEVANT RESIDUES IN SEQ ID NO: (1)..(460)
ttaagatgagagtttgatcctggctcaggacgaacgctggcggcatgcctaatacatgcaagtcgaacgagctttggttgattgacgtgcttgcactgatttcttcttaaagcgagtggcgaactggtgagtaacacgtggaaaacctgcccagaagcaggggataacacttggaaacaggtgctaataccgtataacaacaaaaaccgcatggtttttgtttgaaagatggtttcggctagcacttctggatggttccgcggcgcattagcttgttggtgaggtaacggcccaccaaggcgatgatgcgtagccgacctgagagggtaatcggccacatcgggactgagacacggcccagactcctacgggaggcagcagtagggaatcttccacaatggacgcaagtctgatggagcaatgccgcgtgagtgaagaagggtttcggctcgtaaaactc

SEQ ID NO: 4824 - DNA, 1583 bp, Lactobacillus sp. BHWM-4
  ref <308>: DATABASE ACCESSION NUMBER: NCBI ACCESSION: NZ_CP032626.1
  ref <309>: DATABASE ENTRY DATE: 2019-04-01
  ref <313>: RELEVANT RESIDUES IN SEQ ID NO: (1)..(1583)
ttaagatgagagtttgatcctggctcaggacgaacgctggcggcgtgcctaatacatgcaagtcgaacgagctctcccaaaattgattttatgcttgcataaatgattttttggattcggagcgagtggcgaactggtgagtaacacgtgggtaacctgcccttaagtgggggataacatttggaaacaaatgctaataccgcatatgaattaaaaccgcatggttttaatttgaaagatggctctgctatcacttttggatggacccgcgccgtattagctagttggtgagataaaagcccaccaaggcgatgatacgtagccgacctgagagggtaatcggccacattgggactgagacacggcccagactcctacgggaggcagcagtagggaatcttccacaatggacgaaagtctgatggagcaacgccgcgtgagtgatgaagggtttcggctcgtaaaactctgttgttaaagaagaacaagtgtaagagtaactgtttacgctttgacggtatttaaccagaaagccacggctaactacgtgccagcagccgcggtaatacgtaggtggcaagcgttgtccggatttattgggcgtaaagcgagcgcaggcggtcttgtaagtctgctgtgaaagccctcagcttaactgaggaagtgcagtggaaactacgagacttgagtacagaagaggaaagtggaactccatgtgtagcggtgaaatgcgtagatatatggaagaacaccagtggcgaaggcggctttctggtctgttactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagtggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattattagttgccagcatttagttgggcactctagtgagactgccggtgataaaccggaggaaggtggggatgacgtcaaatcatcatgccccttatgacctgggctacacacgtgctacaatggatggtacaacgagtcgcaaaaccgcgaggtcaagctaatctcttaaagccattctcagttcggattgcaggctgcaactcgcctgcatgaagttggaatcactagtaatcgtggatcagcatgccacggtgaatacgttcccgggccttgtacacaccgcccgtcacaccatgagagtttgtaacacccaaagacgatggggtaaccttcgggagccagtcgtctaaggtgggacagatgattagggtgaagtcgtaacaaggtagccgtaggagaacctgcggctggatcacctcctttctaaggaa

SEQ ID NO: 4825 - DNA, 1583 bp, Lactobacillus sp. CBA3605
  ref <308>: DATABASE ACCESSION NUMBER: NCBI ACCESSION: NZ_CP027190.1
  ref <309>: DATABASE ENTRY DATE: 2019-04-01
  ref <313>: RELEVANT RESIDUES IN SEQ ID NO: (1)..(1583)
ttaatttgagagtttgatcctggctcaggatgaacgctggcggcgtgcctaatacatgcaagtcaaacgaactctggttgttgaatgacggtgcttgcacctgagtgatataacatttgagtgagtggcgaactggtgagtaacacgtgggaaacctgcccagaagtgggggataacacctggaaacagatgctaataccgcataacaactcggaccgcatggtctgagtttgaaagatggctttggctatcacttttggatggtcccgcggcgtattagctagatggtggggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttatccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcctttcagtgctgcagctaacgcattaagcattccgcctggggagtacggtcgcaagactgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagcaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttcgggagccaaccgcctaaggtgggacagatgattagggtgaagtcgtaacaaggtagccgtaggagaacctgcggctggatcacctcctttctaaggaa

SEQ ID NO: 4826 - DNA, 1583 bp, Lactobacillus sp. CBA3606
  ref <308>: DATABASE ACCESSION NUMBER: NCBI ACCESSION: NZ_CP027194.1
  ref <309>: DATABASE ENTRY DATE: 2019-04-01
  ref <313>: RELEVANT RESIDUES IN SEQ ID NO: (1)..(1583)
ttaatttgagagtttgatcctggctcaggatgaacgctggcggcgtgcctaatacatgcaagtcgaacgaactctggttattgaatgacggtgcttgcacctgagtgatatagcatttgagtgagtggcgaactggtgagtaacacgtgggaaacctgcccagaagtgggggataacacctggaaacagatgctaataccgcataacaactcggaccgcatggtctgagtttgaaagatggcttcggctatcacttttggatggtcccgcggcgtattagctagatggtggggtaatggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttatccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggtcgcaagactgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagcaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttcgggagccaaccgcctaaggtgggacagatgattagggtgaagtcgtaacaaggtagccgtaggagaacctgcggctggatcacctcctttctaaggaa

SEQ ID NO: 4827 - DNA, 1576 bp, Lactobacillus sp. D1501
  ref <308>: DATABASE ACCESSION NUMBER: NCBI ACCESSION: NZ_CP028326.1
  ref <309>: DATABASE ENTRY DATE: 2019-04-01
  ref <313>: RELEVANT RESIDUES IN SEQ ID NO: (1)..(1576)
ttaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagcttgaaagatggctttggctatcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctttctaaggaa

SEQ ID NO: 4828 - DNA, 1579 bp, Lactobacillus sp. DS13 6; identical to SEQ ID NO: 4751
  ref <308>: DATABASE ACCESSION NUMBER: NCBI ACCESSION: NZ_QBAA01000074.1
  ref <309>: DATABASE ENTRY DATE: 2019-04-01
  ref <313>: RELEVANT RESIDUES IN SEQ ID NO: (1)..(1579)

SEQ ID NO: 4829 - DNA, 1579 bp, Lactobacillus sp. DS15 6; identical to SEQ ID NO: 4751
  ref <308>: DATABASE ACCESSION NUMBER: NCBI ACCESSION: NZ_QAHV01000076.1
  ref <309>: DATABASE ENTRY DATE: 2019-04-01
  ref <313>: RELEVANT RESIDUES IN SEQ ID NO: (1)..(1579)

SEQ ID NO: 4830 - DNA, 1579 bp, Lactobacillus sp. DS18 6; identical to SEQ ID NO: 4751
  ref <308>: DATABASE ACCESSION NUMBER: NCBI ACCESSION: NZ_QAZZ01000076.1
  ref <309>: DATABASE ENTRY DATE: 2019-04-01
  ref <313>: RELEVANT RESIDUES IN SEQ ID NO: (1)..(1579)

SEQ ID NO: 4831 - DNA, 1579 bp, Lactobacillus sp. DS1 6; identical to SEQ ID NO: 4751
  ref <308>: DATABASE ACCESSION NUMBER: NCBI ACCESSION: NZ_QAHZ01000074.1
  ref <309>: DATABASE ENTRY DATE: 2019-04-01
  ref <313>: RELEVANT RESIDUES IN SEQ ID NO: (1)..(1579)

SEQ ID NO: 4832 - DNA, 1579 bp, Lactobacillus sp. DS22 6; identical to SEQ ID NO: 4751
  ref <308>: DATABASE ACCESSION NUMBER: NCBI ACCESSION: NZ_QAHW01000083.1
  ref <309>: DATABASE ENTRY DATE: 2019-04-01
  ref <313>: RELEVANT RESIDUES IN SEQ ID NO: (1)..(1579)

SEQ ID NO: 4833 - DNA, 1579 bp, Lactobacillus sp. DS2 6; identical to SEQ ID NO: 4751
  ref <308>: DATABASE ACCESSION NUMBER: NCBI ACCESSION: NZ_QAHU01000073.1
  ref <309>: DATABASE ENTRY DATE: 2019-04-01
  ref <313>: RELEVANT RESIDUES IN SEQ ID NO: (1)..(1579)

SEQ ID NO: 4834 - DNA, 1579 bp, Lactobacillus sp. DS3 6; identical to SEQ ID NO: 4751
  ref <308>: DATABASE ACCESSION NUMBER: NCBI ACCESSION: NZ_QAHX01000088.1
  ref <309>: DATABASE ENTRY DATE: 2019-04-01
  ref <313>: RELEVANT RESIDUES IN SEQ ID NO: (1)..(1579)

SEQ ID NO: 4835 - DNA, 1579 bp, Lactobacillus sp. DS9 6; identical to SEQ ID NO: 4751
  ref <308>: DATABASE ACCESSION NUMBER: NCBI ACCESSION: NZ_QAHY01000075.1
  ref <309>: DATABASE ENTRY DATE: 2019-04-01
  ref <313>: RELEVANT RESIDUES IN SEQ ID NO: (1)..(1579)

SEQ ID NO: 4836 - DNA, 1574 bp, Lactobacillus sp. ESL0225
  ref <308>: DATABASE ACCESSION NUMBER: NCBI ACCESSION: NZ_REHK01000014.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaattttaacagaataccttcgggtaggaagataaaagcgcgagcggcggatgggtgagtaacacgtgggcaacctaccctttagcctgggataccacttggaaacaggtgctaataccggataagaagtgagagcacatgctcaagctatgaaaggcggcgtaagctgtcactaaaggatgggcccgcggtgcattagctagttggtaaggtaacggcttaccaaggcgatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaagacaaggatagtaactgattcatgtttgacggtaatcaaccagaaagtcacggctaactacgtgccagcagccgcggtaatacgtaggtggcaagcgttgtccggatttattgggcgtaaagcgaacgcaggcgggaagataagtcagctgtgaaagccctcggctcaaccggggaacggcaactgaaactatttttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgaaaagcctagagataggtaatacccttcggggacactaagacaggtggtgcatggctgtcgtcagctcgtgtcgtgagatgttgggttaagtcccgcaacgagcgcaacccctattattagttgccagcattaagttgggcactctaatgagactgccggtgacaaaccggaggaaggtggggacgacgtcaagtcatcatgccccttatgacctgggctacacacgtgctacaatggttagtacaacgaggagcgagcctgtgaaggtaagcgaatctcttaaagctaatctcagttcggattgcactctgcaactcgagtgcatgaagctggaatcgctagtaatcgcggatcagcatgccgcggtgaatacgttcccgggccttgtacacaccgcccgtcacaccatgagagtttgtaatacccaaagccggtgagataacctgtaaaggggtcagccgtctaaggtaggacagatgattagggtgaagtcgtaacaaggtagccgtaggagaacctgcggctggatcacctcctttctaaggaa

SEQ ID NO: 4837 - DNA, 1576 bp, Lactobacillus sp. ESL0228
  ref <308>: DATABASE ACCESSION NUMBER: NCBI ACCESSION: NZ_REHJ01000013.1
  ref <309>: DATABASE ENTRY DATE: 2019-04-01
  ref <313>: RELEVANT RESIDUES IN SEQ ID NO: (1)..(1576)
aaaaatgagagtttgatcctggctcaggacgaacgctggcggcgtgcctaatacatgcaagtcgagcgagcaattttaacagaataccttcgggtaggaagataaaagcgcgagcggcggatgggtgagtaacacgtgggcaacctgccctttagcctgggataccacttggaaacaggtgctaataccggataagaagtaagaacgcatgttcaagctatgaaaggcggctttcgagctgtcactaaaggatgggcccgcggagcattagctagttggtaaggtaacggcttaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacaaggatagtaactgatttttgtttgacggtaatcaaccagaaagtcacggctaactacgtgccagcagccgcggtaatacgtaggtggcaagcgttgtccggatttattgggcgtaaagcgaacgcaggcgggaagataagtcagctgtgaaagccctcggctcaaccggggaagtgcagctgaaactatatttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgaaaaacctagagataggaaatacccttcggggacactaagacaggtggtgcatggctgtcgtcagctcgtgtcgtgagatgttgggttaagtcccgcaacgagcgcaacccctattattagttgccagcattaagttgggcactctaatgagactgccggtgacaaaccggaggaaggtggggacgacgtcaagtcatcatgccccttatgacctgggctacacacgtgctacaatggttagtacaacgaggagcaagcctgtgaaggtaagcgaatctctaaaagctaatctcagttcggattgcactctgcaactcgagtgcatgaagctggaatcgctagtaatcgcggatcagcatgccgcggtgaatacgttcccgggccttgtacacaccgcccgtcacaccatgagagtttgtaatacccaaagccggtaagataaccagaaaaggagtcagccgtctaaggtaggacagatgattagggtgaagtcgtaacaaggtagccgtaggagaacctgcggctggatcacctcctttctaaggaa

SEQ ID NO: 4838 - DNA, 1574 bp, Lactobacillus sp. ESL0230
  ref <308>: DATABASE ACCESSION NUMBER: NCBI ACCESSION: NZ_REHI01000010.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaattttaacagaataccttcgggtaggaagataaaagcgcgagcggcggatgggtgagtaacacgtgggcaacctaccctttagcctgggataccacttggaaacaggtgctaataccggataagaagtgagagcacatgctcaagctatgaaaggcggcgtaagctgtcactaaaggatgggcccgcggtgcattagctagttggtaaggtaacggcttaccaaggcgatgatgcatagccgagttgagagactgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggtgaagaaagacaaggatagtaactgattcatgtttgacggtaatcaaccagaaagtcacggctaactacgtgccagcagccgcggtaatacgtaggtggcaagcgttgtccggatttattgggcgtaaagcgaacgcaggcgggaagataagtcagctgtgaaagccctcggctcaaccggggaacggcaactgaaactatttttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgaaaagcctagagataggtaatacccttcggggacactaagacaggtggtgcatggctgtcgtcagctcgtgtcgtgagatgttgggttaagtcccgcaacgagcgcaacccctattattagttgccagcattaagttgggcactctaatgagactgccggtgacaaaccggaggaaggtggggacgacgtcaagtcatcatgccccttatgacctgggctacacacgtgctacaatggttagtacaacgaggagcgagcctgtgaaggtaagcgaatctcttaaagctaatctcagttcggattgcactctgcaactcgagtgcatgaagctggaatcgctagtaatcgcggatcagcatgccgcggtgaatacgttcccgggccttgtacacaccgcccgtcacaccatgagagtttgtaatacccaaagccggtgagataacctgtaaaggagtcagccgtctaaggtaggacagatgattagggtgaagtcgtaacaaggtagccgtaggagaacctgcggctggatcacctcctttctaaggaa

SEQ ID NO: 4839 - DNA, 1574 bp, Lactobacillus sp. ESL0233; identical to SEQ ID NO: 4838
  ref <308>: DATABASE ACCESSION NUMBER: NCBI ACCESSION: NZ_REHH01000011.1
  ref <309>: DATABASE ENTRY DATE: 2019-04-01
  ref <313>: RELEVANT RESIDUES IN SEQ ID NO: (1)..(1574)

SEQ ID NO: 4840 - DNA, 1574 bp, Lactobacillus sp. ESL0234; identical to SEQ ID NO: 4836
  ref <308>: DATABASE ACCESSION NUMBER: NCBI ACCESSION: NZ_REHG01000022.1
  ref <309>: DATABASE ENTRY DATE: 2019-04-01
  ref <313>: RELEVANT RESIDUES IN SEQ ID NO: (1)..(1574)

SEQ ID NO: 4841 - DNA, 1574 bp, Lactobacillus sp. ESL0236; identical to SEQ ID NO: 4836
  ref <308>: DATABASE ACCESSION NUMBER: NCBI ACCESSION: NZ_REHF01000021.1
  ref <309>: DATABASE ENTRY DATE: 2019-04-01
  ref <313>: RELEVANT RESIDUES IN SEQ ID NO: (1)..(1574)

SEQ ID NO: 4842 - DNA, 1574 bp, Lactobacillus sp. ESL0237; identical to SEQ ID NO: 4836
  ref <308>: DATABASE ACCESSION NUMBER: NCBI ACCESSION: NZ_REHE01000021.1
  ref <309>: DATABASE ENTRY DATE: 2019-04-01
  ref <313>: RELEVANT RESIDUES IN SEQ ID NO: (1)..(1574)

SEQ ID NO: 4843 - DNA, 1576 bp, Lactobacillus sp. ESL0245
  ref <308>: DATABASE ACCESSION NUMBER: NCBI ACCESSION: NZ_REHD01000019.1
  ref <309>: DATABASE ENTRY DATE: 2019-04-01
  ref <313>: RELEVANT RESIDUES IN SEQ ID NO: (1)..(1576)
aaaaatgagagtttgatcctggctcaggacgaacgctggcggcgtgcctaatacatgcaagtcgagcgagcaattttaacagaataccttcgggtaggaagataaaagcgcgagcggcggatgggtgagtaacacgtgggcaacctgccctttagcctgggataccacttggaaacaggtgctaataccggataagaagtaagaacgcatgttcaagctatgaaaggcggctttcgagctgtcactaaaggatgggcccgcggagcattagctagttggtaaggtaacggcttaccaaggcgatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacaaggatagtaactgatttttgtttgacggtaatcaaccagaaagtcacggctaactacgtgccagcagccgcggtaatacgtaggtggcaagcgttgtccggatttattgggcgtaaagcgaacgcaggcgggaagataagtcagctgtgaaagccctcggctcaaccggggaagtgcagctgaaactatatttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgaaaaacctagagataggaaatacccttcggggacactaagacaggtggtgcatggctgtcgtcagctcgtgtcgtgagatgttgggttaagtcccgcaacgagcgcaacccctattattagttgccagcattaagttgggcactctaatgagactgccggtgacaaaccggaggaaggtggggacgacgtcaagtcatcatgccccttatgacctgggctacacacgtgctacaatggttagtacaacgaggagcaagcctgtgaaggcaagcgaatctctaaaagctaatctcagttcggattgcactctgcaactcgagtgcatgaagctggaatcgctagtaatcgcggatcagcatgccgcggtgaatacgttcccgggccttgtacacaccgcccgtcacaccatgagagtttgtaatacccaaagccggtaagataacctgaaaaggagtcagccgtctaaggtaggacagatgattagggtgaagtcgtaacaaggtagccgtaggagaacctgcggctggatcacctcctttctaaggaa

SEQ ID NO: 4844 - DNA, 1576 bp, Lactobacillus sp. ESL0246; identical to SEQ ID NO: 4843
  ref <308>: DATABASE ACCESSION NUMBER: NCBI ACCESSION: NZ_REHC01000018.1
  ref <309>: DATABASE ENTRY DATE: 2019-04-01
  ref <313>: RELEVANT RESIDUES IN SEQ ID NO: (1)..(1576)

SEQ ID NO: 4845 - DNA, 1576 bp, Lactobacillus sp. ESL0247; identical to SEQ ID NO: 4843
  ref <308>: DATABASE ACCESSION NUMBER: NCBI ACCESSION: NZ_REHB01000019.1
  ref <309>: DATABASE ENTRY DATE: 2019-04-01
  ref <313>: RELEVANT RESIDUES IN SEQ ID NO: (1)..(1576)

SEQ ID NO: 4846 - DNA, 1574 bp, Lactobacillus sp. ESL0259
  ref <308>: DATABASE ACCESSION NUMBER: NCBI ACCESSION: NZ_REHP01000017.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaattttgacagaatacttcggtaggaagttaagagcgcgagcggcggatgggtgagtaacacgtgggcaacctgccctttagcttgggataccacttggaaacaggtgctaataccaaataagcagcaagagcgcatgctcaagctgagaaaggcggctttggagctgtcactaaaggatgggcccgcggtgcattagctagttggtaaggtaaaggcctaccaaggcgatgatgcatagccgagttgagagactgaccggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacaagggtagtaactgatctttgtttgacggtaatcaaccagaaagtcacggctaactacgtgccagcagccgcggtaatacgtaggtggcaagcgttgtccggatttattgggcgtaaagcgaacgcaggcgggaagataagtcagctgtgaaagcccccagcttaactggggaattgcagctgaaactatgtttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgccagtcctagagataggatgtttccttcgggaacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgagcagcgaacctgcaaaggcaagcgaatctctgaaagctaatctcagttcggattgcactctgcaactcgagtgcatgaagctggaatcgctagtaatcgcggatcagcacgccgcggtgaatacgttcccgggccttgtacacaccgcccgtcacaccatgagagtctgtaatgcccaaagccggtgggataacctgcaaaggagtcagccgtctaaggcaggacagatgattagggtgaagtcgtaacaaggtagccgtaggagaacctgcggctggatcacctcctttctaaggaa

SEQ ID NO: 4847 - DNA, 1574 bp, Lactobacillus sp. ESL0260
  ref <308>: DATABASE ACCESSION NUMBER: NCBI ACCESSION: NZ_REHO01000020.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaattttaacggaatacttcggtaggaagttagaagcgcgagcggcggatgggtgagtaacacgtgggcaacctgccctttagcttgggataccacttggaaacaggtgctaataccaaataagaagcaagagcgcatgctcaagcagtaaaaggcggctttcgagctgtcactaaaggatgggcccgcggtgcattagctagttggtaaggtaacggcctaccaaggcaatgatgcatagccgagttgagagactgaccggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacaagggtagtaactgatttttgtttgacggtaatcaaccagaaagtcacggctaactacgtgccagcagccgcggtaatacgtaggtggcaagcgttgtccggatttattgggcgtaaagcgaacgcaggcgggaagataagtcagctgtgaaagcccccagcttaactggggaactgcagctgaaactatgtttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgccagtcctagagataggatgtttccttcgggaacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgagcagcgaacctgcaaaggcaagcgaatctctgaaagctaatctcagttcggattgcactctgcaactcgagtgcatgaagctggaatcgctagtaatcgcggatcagcacgccgcggtgaatacgttcccgggccttgtacacaccgcccgtcacaccatgagagtctgtaatgcccaaagccggtgggataacctgcaaaggagtcagccgtctaaggcaggacagatgattagggtgaagtcgtaacaaggtagccgtaggagaacctgcggctggatcacctcctttctaaggaa

SEQ ID NO: 4848 - DNA, 1574 bp, Lactobacillus sp. ESL0261
  ref <308>: DATABASE ACCESSION NUMBER: NCBI ACCESSION: NZ_REHN01000016.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaatcttaacggaatacttcggtaggaagtcaagagcgcgagcggcggatgggtgagtaacacgtgggcaacctgccctatagcttgggataccacttggaaacaggtgctaataccaaataagcagcaagagcgcatgctcaagctgggaaaggcggctttaaagctgtcactacaggatgggcccgcggtgcattagctagttggcaaggtaacggcctaccaaggcgatgatgcatagccgagttgagagactgaccggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacagggaaagcaactggtccctgtttgacggtaatcaaccagaaagtcacggctaactacgtgccagcagccgcggtaatacgtaggtggcaagcgttgtccggatttattgggcgtaaagcgaacgcaggcgggagaataagtcagctgtgaaagccctcagcttaactggggaactgcagctgaaactatttttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagcgccagtcctagagataggatgtttccttcgggaacgctaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgagcagcgaacctgcaaaggcaagcgaatctctgaaagctaatctcagttcggattgcactctgcaactcgagtgcatgaagctggaatcgctagtaatcgcggatcagcacgccgcggtgaatacgttcccgggccttgtacacaccgcccgtcacaccatgagagtctgtaatgcccaaagccggtaggataacctgcaaaggagtcagccgtctaaggcaggacagatgattagggtgaagtcgtaacaaggtagccgtaggagaacctgcggctggatcacctcctttctaaggaa

SEQ ID NO: 4849 - DNA, 1574 bp, Lactobacillus sp. ESL0262
  ref <308>: DATABASE ACCESSION NUMBER: NCBI ACCESSION: NZ_REHM01000014.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaattttgacggaatacttcggtaggaagtcagaagcgcgagcggcggatgggtgagtaacacgtgggcaacctgccctttagcttgggataccacttggaaacaggtgctaataccaaataagcagcacgagcgcatgctcaagctgagaaaggcggctttcgagctgtcactaaaggatgggcccgcggtgcattagctagttggtaaggtaacggcttaccaaggcgatgatgcatagccgagttgagagactgaccggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacaagggtagtaactgattcttgtttgacggtaatcaaccagaaagtcacggctaactacgtgccagcagccgcggtaatacgtaggtggcaagcgttgtccggatttattgggcgtaaagcgaacgcaggcgggagaataagtcagctgtgaaagcccccagcttaactggggaagtgcaactgaaactatttttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgccagtcctagagataggatgtttccttcgggaacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgagcagcgaacctgcaaaggcaagcgaatctctgaaagctaatctcagttcggattgcactctgcaactcgagtgcatgaagctggaatcgctagtaatcgcggatcagcacgccgcggtgaatacgttcccgggccttgtacacaccgcccgtcacaccatgagagtctgtaatgcccaaagccggtaggataacctgcaaaggagtcagccgtctaaggcaggacagatgattagggtgaagtcgtaacaaggtagccgtaggagaacctgcggctggatcacctcctttctaaggaa

SEQ ID NO: 4850 - DNA, 1574 bp, Lactobacillus sp. ESL0263
  ref <308>: DATABASE ACCESSION NUMBER: NCBI ACCESSION: NZ_REHL01000010.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaaagttaaaggaatacttcggtaggaatttaatagcgcgagcggcggatgggtgagtaacacgtgggcaatctaccctttagcttgggataccacttggaaacaggtgctaataccaaataagaagtaagagcgcatgctcaagctatgaaaggcggctttcgagctgtcactaaaggatgagcccgcggtgcattagctagttggtaaggtaacggcttaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacatagatagtaactgatctatgtttgacggtaatcaaccagaaagtcacggctaactacgtgccagcagccgcggtaatacgtaggtggcaagcgttgtccggatttattgggcgtaaagcgaacgcaggcgggagaacaagtcagctgtgaaagccctcggcttaaccgaggaacggcaactgaaactgtttttcttgagtgcagaagaggagagtggaactccatgtgtagcggtgaaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgcaaaccctagagatagggtgtttccttcgggaacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgaggagcgaacctgtgaaggcaagcgaatctcttaaagctaatctcagttcggattgcactctgcaactcgagtgcatgaagctggaatcgctagtaatcgcggatcagcatgccgcggtgaatacgttcccgggccttgtacacaccgcccgtcacaccatgagagtttgtaatacccaaagccggtgagataacctgtaaaggagtcagccgtctaaggtaggacagatgattagggtgaagtcgtaacaaggtagccgtaggagaacctgcggctggatcacctcctttctaaggaa

SEQ ID NO: 4851 - DNA, 1575 bp, Lactobacillus sp. FI11369
  ref <308>: DATABASE ACCESSION NUMBER: NCBI ACCESSION: NZ_QWZQ01000080.1
  ref <309>: DATABASE ENTRY DATE: 2019-04-01
  ref <313>: RELEVANT RESIDUES IN SEQ ID NO: (1)..(1575)
ttaatttgagagtttgatcctggctcaggacgaacgctggcggcgtgcctaatacatgcaagtcgaacgaactctggtattgattggtgcttgcatcatgaaatacatttgagtgagtggcgaactggtgagtaacacgtgggaaacctgcccagaagcgggggataacacctggaaacagatgctaataccgcataacaacttggaccgcatggtccgagcttgaaagatggcttcggctatcacttctggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactacgctaacctgagagatcaggcgttcccttcggggacgtggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttcgggaaccagccgcctaaggtgggacagatgattagggtgaagtcgtaacaaggtagccgtaggagaacctgcggctggatcacctcctttctaaggaa

SEQ ID NO: 4852 - DNA, 1579 bp, Lactobacillus sp. FMNP02
  ref <308>: DATABASE ACCESSION NUMBER: NCBI ACCESSION: NZ_KN714895.1
  ref <309>: DATABASE ENTRY DATE: 2019-04-01
  ref <313>: RELEVANT RESIDUES IN SEQ ID NO: (1)..(1579)
tttatatgagagtttgatcctggctcaggatgaacgctggcggcgtgcctaatacatgcaagtcgaacgagttttggtcgatgaacggtgcttgcactgagattcgacttaaaacgagtggcggacgggtgagtaacacgtgggtaacctgcccttaagtgggggataacatttggaaacagatgctaataccgcataaatccaagaaccgcatggttcttggctgaaagatggcgcaagctatcgcttttggatggacccgcggcgtattagctagttggtgaggtaacggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcattgagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4853 - DNA, 1574 bp, Lactobacillus sp. HBUAS52074
  ref <308>: DATABASE ACCESSION NUMBER: NCBI ACCESSION: NZ_CP031933.1
  ref <309>: DATABASE ENTRY DATE: 2019-04-01
  ref <313>: RELEVANT RESIDUES IN SEQ ID NO: (1)..(1574)
taatatgagagtttgatcctggctcaggacgaacgctggcggcatgcctaatacatgcaagtcgaacgaactctgctgatgattgaagcttgcttcatgaatcagttttgagtgagtggcggacgggtgagtaacacgtgggtaacctgcccaaaagtgggggataacatttggaaacaagtgctaataccgcataacaactactttcacatgatcgtagcttgaaagatggctctgctatcgcttttggatggacccgcggcgtattagctagttggtgaggtaatagctcaccaaggcaatgatacgtagccgacctgagagggtaatcggccacattgggactgagacacggcccaaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccatgaaaagcttagagataagtctttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaacccttcggggagctaaccgtctaaggtgggacaaatgattagggtgaagtcgtaacaaggtagccgtaggagaacctgcggctggatcacctcctttctaagga

SEQ ID NO: 4854 - DNA, 1508 bp, Lactobacillus sp. HMSC056D05
  ref <308>: DATABASE ACCESSION NUMBER: NCBI ACCESSION: NZ_KV816381.1
  ref <309>: DATABASE ENTRY DATE: 2019-04-01
  ref <313>: RELEVANT RESIDUES IN SEQ ID NO: (1)..(1508)
ttctgattattgaaaggtgcttgcatcttgatttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4855 - DNA, 1579 bp, Lactobacillus sp. HMSC061B07; identical to SEQ ID NO: 4773
  ref <308>: DATABASE ACCESSION NUMBER: NCBI ACCESSION: NZ_KV810121.1
  ref <309>: DATABASE ENTRY DATE: 2019-04-01
  ref <313>: RELEVANT RESIDUES IN SEQ ID NO: (1)..(1579)

SEQ ID NO: 4856 - DNA, 1579 bp, Lactobacillus sp. HMSC064F12; identical to SEQ ID NO: 4773
  ref <308>: DATABASE ACCESSION NUMBER: NCBI ACCESSION: NZ_KV798644.1
  ref <309>: DATABASE ENTRY DATE: 2019-04-01
  ref <313>: RELEVANT RESIDUES IN SEQ ID NO: (1)..(1579)

SEQ ID NO: 4857 - DNA, 1477 bp, Lactobacillus sp. HMSC066G01
  ref <308>: DATABASE ACCESSION NUMBER: NCBI ACCESSION: NZ_KV807949.1
  ref <309>: DATABASE ENTRY DATE: 2019-04-01
  ref <313>: RELEVANT RESIDUES IN SEQ ID NO: (1)..(1477)
tttaattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4858 - DNA, 1449 bp, Lactobacillus sp. HMSC068B07
  ref <308>: DATABASE ACCESSION NUMBER: NCBI ACCESSION: NZ_KV798309.1
  ref <309>: DATABASE ENTRY DATE: 2019-04-01
  ref <313>: RELEVANT RESIDUES IN SEQ ID NO: (1)..(1449)
gagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4859 - DNA, 1467 bp, Lactobacillus sp. HMSC068F07
  ref <308>: DATABASE ACCESSION NUMBER: NCBI ACCESSION: NZ_KV809188.1
  ref <309>: DATABASE ENTRY DATE: 2019-04-01
  ref <313>: RELEVANT RESIDUES IN SEQ ID NO: (1)..(1467)
aacgagtggcggacgggtgagtaacacgtgggtaacctgcccttaagtgggggacaacatttggaaacagatgctaataccgcataaatccaagaaccgcatggttcttggctgaaagatggcgtaagctatcgcttttggatggacccgcggcgtattagctagttggtgaggtaacggctcaccaaggccatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4860 - DNA, 1579 bp, Lactobacillus sp. HMSC072E07; identical to SEQ ID NO: 4773
  ref <308>: DATABASE ACCESSION NUMBER: NCBI ACCESSION: NZ_KV797748.1
  ref <309>: DATABASE ENTRY DATE: 2019-04-01
  ref <313>: RELEVANT RESIDUES IN SEQ ID NO: (1)..(1579)

SEQ ID NO: 4861 - DNA, 1477 bp, Lactobacillus sp. HMSC073B09; identical to SEQ ID NO: 4857
  ref <308>: DATABASE ACCESSION NUMBER: NCBI ACCESSION: NZ_KV814121.1
  ref <309>: DATABASE ENTRY DATE: 2019-04-01
  ref <313>: RELEVANT RESIDUES IN SEQ ID NO: (1)..(1477)

SEQ ID NO: 4862 - DNA, 1579 bp, Lactobacillus sp. HMSC073D04; identical to SEQ ID NO: 4773
  ref <308>: DATABASE ACCESSION NUMBER: NCBI ACCESSION: NZ_KV820562.1
  ref <309>: DATABASE ENTRY DATE: 2019-04-01
  ref <313>: RELEVANT RESIDUES IN SEQ ID NO: (1)..(1579)

SEQ ID NO: 4863 - DNA, 1579 bp, Lactobacillus sp. HMSC075D02; identical to SEQ ID NO: 4773
  ref <308>: DATABASE ACCESSION NUMBER: NCBI ACCESSION: NZ_KV816003.1
  ref <309>: DATABASE ENTRY DATE: 2019-04-01
  ref <313>: RELEVANT RESIDUES IN SEQ ID NO: (1)..(1579)

SEQ ID NO: 4864 - DNA, 1579 bp, Lactobacillus sp. HMSC077C11; identical to SEQ ID NO: 4773
  ref <308>: DATABASE ACCESSION NUMBER: NCBI ACCESSION: NZ_KV799513.1
  ref <309>: DATABASE ENTRY DATE: 2019-04-01
  ref <313>: RELEVANT RESIDUES IN SEQ ID NO: (1)..(1579)

SEQ ID NO: 4865 - DNA, 1579 bp, Lactobacillus sp. HMSC078F07; identical to SEQ ID NO: 4773
  ref <308>: DATABASE ACCESSION NUMBER: NCBI ACCESSION: NZ_KV800023.1
  ref <309>: DATABASE ENTRY DATE: 2019-04-01
  ref <313>: RELEVANT RESIDUES IN SEQ ID NO: (1)..(1579)

SEQ ID NO: 4866 - DNA, 871 bp, Lactobacillus sp. HMSC08B12
  ref <308>: DATABASE ACCESSION NUMBER: NCBI ACCESSION: NZ_KV793200.1
  ref <309>: DATABASE ENTRY DATE: 2019-04-01
  ref <313>: RELEVANT RESIDUES IN SEQ ID NO: (1)..(871)
ctgggataccacttggaaacaggtgctaataccggataacaacatgaatcgcatgattcaagtttgaaaggcggcgcaagctgtcactttaggatgagcccgcggcgcattagctagttggtggggtaaaggcctaccaaggcaatgatgcgtagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggcagtaactggtctttatttgacggtaatcaaccagaaagtcacggctaactacgtgccagcagccgcggtaatacgtaggtggcaagcgttgtccggatttattgggcgtaaagcgagcgcaggcggaatgataagtctgatgtgaaagcccacggctcaaccgtggaactgcatcggaaactgtcattcttgagtgcagaagaggagagtggaactccatgtgtagcggtggaatgcgcagagatatggaagaacaccagtggcgaaggcggctctctggtctgcaactgacgctgaggctcgaaagcatgggtagcgaacaggattagataccctggtagtccatgccgtaaacgatgagcgctaggtgttggggactttccggtcctcagtgccgcagcaaacgcattaagcgctccgcctggggagtacgaccgcaaggttgaaactcaaaggaattgacgggggcccgcacaagcggtggagcatgtggtttaattcgaagcaacgcgaagaaccttaccaggtcttgacatcctgcgc

SEQ ID NO: 4867 - DNA, 1579 bp, Lactobacillus sp. HMSC17G08
  ref <308>: DATABASE ACCESSION NUMBER: NCBI ACCESSION: NZ_KV789468.1
  ref <309>: DATABASE ENTRY DATE: 2019-04-01
  ref <313>: RELEVANT RESIDUES IN SEQ ID NO: (1)..(1579)
tttatatgagagtttgatcctggctcaggatgaacgctggcggcgtgcctaatacatgcaagtcgaacgagttctgattattgaaaggtgcttgcatcttgatttgattttgaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggtcaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4868 - DNA, 1464 bp, Lactobacillus sp. HMSC24D01
  ref <308>: DATABASE ACCESSION NUMBER: NCBI ACCESSION: NZ_KV789714.1
  ref <309>: DATABASE ENTRY DATE: 2019-04-01
  ref <313>: RELEVANT RESIDUES IN SEQ ID NO: (1)..(1464)
cgagtggcggacgggtgagtaacacgtaggtaacctgcccagaagcgggggacaacatttggaaacagatgctaataccgcataacaacgttgttcgcatgaacaacgcttaaaagatggcttctcgctatcacttctggatggacctgcggtgcattagcttgttggtggggtaacggcctaccaaggcgatgatgcatagccgagttgagagactgatcggccacaatgggactgagacacggcccatactcctacgggaggcagcagtagggaatcttccacaatgggcgcaagcctgatggagcaacaccgcgtgagtgaagaagggtttcggctcgtaaagctctgttgttaaagaagaacacgtatgagagtaactgttcatacgttgacggtatttaaccagaaagtcacggctaactacgtgccagcagccgcggtaatacgtaggtggcaagcgttatccggatttattgggcgtaaagagagtgcaggcggttttctaagtctgatgtgaaagccttcggcttaaccggagaagtgcatcggaaactggataacttgagtgcagaagagggtagtggaactccatgtgtagcggtggaatgcgtagatatatggaagaacaccagtggcgaaggcggctacctggtctgcaactgacgctgagactcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgccaaccctagagatagggcgtttccttcgggaacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcgaactcgcgagggcaagcaaatctcttaaaaccgttctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttctaaggaa

SEQ ID NO: 4869 - DNA, 1579 bp, Lactobacillus sp. HMSC25A02; identical to SEQ ID NO: 4751
  ref <308>: DATABASE ACCESSION NUMBER: NCBI ACCESSION: NZ_KV824725.1
  ref <309>: DATABASE ENTRY DATE: 2019-04-01
  ref <313>: RELEVANT RESIDUES IN SEQ ID NO: (1)..(1579)

SEQ ID NO: 4870 - DNA, 1572 bp, Lactobacillus sp. HT06-2
  ref <308>: DATABASE ACCESSION NUMBER: NCBI ACCESSION: NZ_PQGL01000059.1
  ref <309>: DATABASE ENTRY DATE: 2019-04-01
  ref <313>: RELEVANT RESIDUES IN SEQ ID NO: (1)..(1572)
aaaaatgagagtttgatcctggctcaggacgaacgctggcggcgtgcctaatacatgcaagtcgagcgagcagaactaacagatttacttcggtaatgacgtttcggacgcgagcggcggatgggtgagtaacacgtgggtaacctgcccttaagtctgggataccacttggaaacaggtgctaataccggataacaactagtgctgcatggcactagcttaaaaggcggcgtaagctgtcgctaaaggatggacccgcggtgcattagctagttggtaaggtaacggcttaccaaggcgacgatgcatagccgagttgagagactgatcggccacattgggactgagacacggcccaaactcctacgggaggcagcagtagggaatcttccacaatgggcgaaagcctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggagaaataagtctgatgtgaaagccctcggcttaaccgaggaagtgcatcagaaactgtttttcttgagtgcagaagaggagagtggaactccatgtgtagcggtggaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctggtgcaaacctaagagattaggcgttcccttcggggacaccaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggacgacgtcaagtcatcatgccccttatgacctgggctacacacgtgctacaatgggcagtacaacgaggagcgaacctgtgaaggcaagcgaatctctgaaagctgttctcagttcggactgtaggctgcaactcgcctacacgaagctggaatcgctagtaatcgcggatcagcacgccgcggtgaatacgttcccgggccttgtacacaccgcccgtcacaccatggaagtctgcaatgcccaaagccggtggcctaaccttcgggaaggagccgtctaaggcagggcagatgactggggtgaagtcgtaacaaggtagccgtaggagaacctgcggctggatcacctcctttctaaggaa

SEQ ID NO: 4871 - DNA, 1572 bp, Lactobacillus sp. HT111-2; identical to SEQ ID NO: 4870
  ref <308>: DATABASE ACCESSION NUMBER: NCBI ACCESSION: NZ_ML136921.1
  ref <309>: DATABASE ENTRY DATE: 2019-04-01
  ref <313>: RELEVANT RESIDUES IN SEQ ID NO: (1)..(1572)

SEQ ID NO: 4872 - DNA, 1572 bp, Lactobacillus sp. HT170-2; identical to SEQ ID NO: 4870
  ref <308>: DATABASE ACCESSION NUMBER: NCBI ACCESSION: NZ_ML137017.1
  ref <309>: DATABASE ENTRY DATE: 2019-04-01
  ref <313>: RELEVANT RESIDUES IN SEQ ID NO: (1)..(1572)

SEQ ID NO: 4873 - DNA, 1575 bp, Lactobacillus sp. M1530-1
  ref <308>: DATABASE ACCESSION NUMBER: NCBI ACCESSION: NZ_RHOB01000044.1
  ref <309>: DATABASE ENTRY DATE: 2019-04-01
  ref <313>: RELEVANT RESIDUES IN SEQ ID NO: (1)..(1575)
ttaagatgagagtttgatcctggctcaggacgaacgctggcggcatgcctaatacatgcaagtcgaacgagcttccgttgattgacgtgcttgcactgatttcaaccatgaagcgagtggcgaactggtgagtaacacgtgggaaatctgcccagaagcaggggataacacttggaaacaggtgctaataccgtataacaacaagaaccgcatggttcttgtttgaaaggtggcttcggctatcacttctggatgatcccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacctctgagagtaactgttcaggggttgacggtatttaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccggagaagtgcatcggaaactgggtaacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatcttagagataagacgttcccttcggggacagaatgacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggacggtacaacgagtcgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4874 - DNA, 1582 bp, Lactobacillus sp. M1575
  ref <308>: DATABASE ACCESSION NUMBER: NCBI ACCESSION: NZ_RHOM01000059.1
  ref <309>: DATABASE ENTRY DATE: 2019-04-01
  ref <313>: RELEVANT RESIDUES IN SEQ ID NO: (1)..(1582)
aaaatatgagagtttgatcctggctcaggatgaacgctggcggcgtgcctaatacatgcaagtcgagcgaactctggtaactgatttttgatgcttgcatcaaaatgaagatacatttgagtgagcggcggatgggtgagtaacacgtgggtaacctgccctaaagtgggggataacatctggaaacaggtgctaataccgcataacaacaatttccacatggtcattgtttgaaagatggttctgctatcgctttaggatggacccgcggcgtattagctagttggtgaggtaacggctcaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttatccggatttattgggcgtaaagcgagtgcaggcggtttataaggtctgatgtgaaagccctcggctcaaccgaggaagtgcatcggaaaccggtaaacttgagtgcagaagaggagagtggaactccatgtgtagcggtggaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccatgaaagtctaagagattagaggttcccttcggggacatggatacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaagga

SEQ ID NO: 4875 - DNA, 1583 bp, Lactobacillus sp. Marseille-P3519
  ref <308>: DATABASE ACCESSION NUMBER: NCBI ACCESSION: NZ_FTOY01000011.1
  ref <309>: DATABASE ENTRY DATE: 2019-04-01
  ref <313>: RELEVANT RESIDUES IN SEQ ID NO: (1)..(1583)
tttatatgagagtttgatcctggctcaggatgaacgccggcggtgtgcctaatacatgcaagtcgtacgcactggcccaactgattgatggtgcttgcaccagattgacgatggatcaccagtgagtggcggacgggtgagtaacacgtgggtaacctgccccggagcgggggataacatttggaaacagatgctaataccgcataactacgaagaccacatggtcttcgtataaaagatggctctgctatcactctgggatggacccgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtacctgagagtaactgttcaggtagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagttgcgaactcgcgagggtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatggaagtttgtaacgcccaaagtcggtggcctaaccatttggagggagccgcctaaggcgggacagatgactggggtgaagtcgtaacaaggtagccgtaggagaacctgcggctggatcacctcctttctaaggaa

SEQ ID NO: 4876 - DNA, 1578 bp, Lactobacillus sp. NRIC 1947
  ref <308>: DATABASE ACCESSION NUMBER: NCBI ACCESSION: NZ_NOXN01000118.1
  ref <309>: DATABASE ENTRY DATE: 2019-04-01
  ref <313>: RELEVANT RESIDUES IN SEQ ID NO: (1)..(1578)
tttatatgagagtttgatcctggctcaggatgaacgctggcggcgtgcctaatacatgcaagtcgaacgagttttggtcgatgaacggtgcttgcactgtgattcaacttaaaacgagtggcggacgggtgagtaacacgtgggtaacctgccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggttaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4877 - DNA, 1434 bp, Lactobacillus sp. PFC-70
  ref <308>: DATABASE ACCESSION NUMBER: NCBI ACCESSION: NZ_PZQL01000070.1
  ref <309>: DATABASE ENTRY DATE: 2019-04-01
  ref <313>: RELEVANT RESIDUES IN SEQ ID NO: (1)..(1434)
cctaatacatgcaagtcgaacgagttcccgttgattgacgtgcttgcactgatttcaacattggaacgagtggcgaactggtgagtaacacgtggaaaacctgcccagaagcaggggataacacttggaaacaggtgctaataccgtataacaacaaaaaccgcatggtttttgtttgaaaggtggcttcggctatcacttctggatggttccgcggcgcattagcttgttggtggggtaacggctcaccaaggcgatgatgcgtagccgacctgagagggtaatcggccacattgggactgagacacggcccagactcctacgggaggcagcagtagggaatcttccacaatggacgcaagtctgatggagcaatgccgcgtgagtgaagaagggtttcggctcgtaaaactctgttgttgaagaagaacgggtgtcagagtaactgttgacatcgtgacggtattcaaccagaaagccacggctaactacgtgccagcagccgcggtaatacgtaggtggcaagcgttgtccggatttattgggcgtaaagcgagcgcaggcggtttcttaagtctgatgtgaaagccttcggcttaaccgaagaagtgcatcggaaactggggaacttgagtgcagaagaggacagtggaactccatgtgtagcggtggaatgcgtagatatatggaagaacaccagtggcgaaggcggctgtctagtctgcaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatcttagagataagacgttcccttcggggacagaatgacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggacggtacaacgagtcgcaaagtcgcgaggctaagctaatctcttaaagccgttctcagttcggattgcaggctgcaactcgcctacatgaagttggaatcgctagtaatcgcggatcagcatgccgcggtgaatacgttcccgggccttgtacacaccgcccgtcacaccatgagagtttgtaacacccaaagccggtgaggtaaccttttgga

SEQ ID NO: 4878 - DNA, 1585 bp, Lactobacillus sp. UMNPBX10
  ref <308>: DATABASE ACCESSION NUMBER: NCBI ACCESSION: NZ_PCZL01000127.1
  ref <309>: DATABASE ENTRY DATE: 2019-04-01
  ref <313>: RELEVANT RESIDUES IN SEQ ID NO: (1)..(1585)
tttatatgagagtttgatcctggctcaggatgaacgccggcggtgtgcctaatacatgcaagtcgtacgcactggcccaactgattgatggtgcttgcacctgattgacgatggatcaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaa

SEQ ID NO: 4879 - DNA, 1585 bp, Lactobacillus sp. UMNPBX13
  ref <308>: DATABASE ACCESSION NUMBER: NCBI ACCESSION: NZ_PCYX01000134.1
  ref <309>: DATABASE ENTRY DATE: 2019-04-01
  ref <313>: RELEVANT RESIDUES IN SEQ ID NO: (1)..(1585)
tttatatgagagtttgatcctggctcaggatgaacgccggcggtgtgcctaatacatgcaagtcgtacgcactggcccaactgattgatggtgcttgcacctgattgacgatggattaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaa

SEQ ID NO: 4880 - DNA, 1585 bp, Lactobacillus sp. UMNPBX18; identical to SEQ ID NO: 4879
  ref <308>: DATABASE ACCESSION NUMBER: NCBI ACCESSION: NZ_PCYS01000183.1
  ref <309>: DATABASE ENTRY DATE: 2019-04-01
  ref <313>: RELEVANT RESIDUES IN SEQ ID NO: (1)..(1585)

SEQ ID NO: 4881 - DNA, 1584 bp, Lactobacillus sp. UMNPBX19
  ref <308>: DATABASE ACCESSION NUMBER: NCBI ACCESSION: NZ_PCYR01000061.1
  ref <309>: DATABASE ENTRY DATE: 2019-04-01
  ref <313>: RELEVANT RESIDUES IN SEQ ID NO: (1)..(1584)
aaggaaaatgagagtttgatcctggctcaggacgaacgctggcggcgtgcctaatacatgcaagtcgagcgagcttgcctagatgattttagtgcttgcactaaatgaaactagatacaagcgagcggcggacgggtgagtaacacgtgggtaacctgcccaagagactgggataacacctggaaacagatgctaataccggataacaacactagacgcatgtctagagtttgaaagatggttctgctatcactcttggatggacctgcggtgcattagctagttggtaaggtaacggcttaccaaggcaatgatgcatagccgagttgagagactgatcggccacattgggactgagacacggcccaaactcctacgggaggcagcagtagggaatcttccacaatggacgaaagtctgatggagcaacgccgcgtgagtgaagaagggtttcggctcgtaaagctctgttggtagtgaagaaagatagaggtagtaactggcctttatttgacggtaattacttagaaagtcacggctaactacgtgccagcagccgcggtaatacgtaggtggcaagcgttgtccggatttattgggcgtaaagcgagtgcaggcggttcaataagtctgatgtgaaagccttcggctcaaccggagaattgcatcagaaactgttgaacttgagtgcagaagaggagagtggaactccatgtgtagcggtggaatgcgtagatatatggaagaacaccagtggcgaaggcggctctctggtctgtaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccagtgcaaacctaagagattaggtgttcccttcggggacgctgagacaggtggtgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcatcatgccccttatgacctgggctacacacgtgctacaatggacggtacaacgagaagcgaacctgcgaaggcaagcggatctcttaaagccgttctcagttcggactgtaggctgcaactcgcctacacgaagctggaatcgctagtaatcgcggatcagcacgccgcggtgaatacgttcccgggccttgtacacaccgcccgtcacaccatgagagtctgtaacacccaaagccggtgggataacctttataggagtcagccgtctaaggtaggacagatgattagggtgaagtcgtaacaaggtagccgtaggagaacctgcggctggatcacctcctttctaaggaa

SEQ ID NO: 4882 - DNA, 1570 bp, Lactobacillus sp. UMNPBX2
  ref <308>: DATABASE ACCESSION NUMBER: NCBI ACCESSION: NZ_PCZH01000078.1
  ref <309>: DATABASE ENTRY DATE: 2019-04-01
  ref <313>: RELEVANT RESIDUES IN SEQ ID NO: (1)..(1570)
taaaatgagagtttgatcctggctcaggacgaacgctggcggcgtgcctaatacatgcaagtcgaacgaaactttcttacaccgaatgcttgcattcaccgtaagaagttgagtggcggacgggtgagtaacacgtgggtaacctgcctaaaagaaggggataacacttggaaacaggtgctaataccgtatatctctaaggatcgcatgatccttagatgaaagatggttctgctatcgcttttagatggacccgcggcgtattaactagttggtggggtaacggcctaccaaggtgatgatacgtagccgaactgagaggttgatcggccacattgggactgagacacggcccaaactcctacgggaggcagcagtagggaatcttccacaatggacgcaagtctgatggagcaacgccgcgtgagtgaagaaggtcttcggatcgtaaaactctgttgttagagaagaacacgagtgagagtaactgttcattcgatgacggtatctaaccagcaagtcacggctaactacgtgccagcagccgcggtaatacgtaggtggcaagcgttgtccggatttattgggcgtaaagggaacgcaggcggtcttttaagtctgatgtgaaagccttcggcttaaccggagtagtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaggtgttggagggtttccgcccttcagtgccgcagctaacgcaataagcattccgcctggggagtacgaccgcaaggttgaaactcaaaggaattgacgggggcccgcacaagcggtggagcatgtggtttaattcgaagcaacgcgaagaaccttaccaggtcttgacatcctttgaccacctaagagattaggctttcccttcggggacaaagtgacaggtggtgcatggctgtcgtcagctcgtgtcgtgagatgttgggttaagtcccgcaacgagcgcaacccttgttgtcagttgccagcattaagttgggcactctggcgagactgccggtgacaaaccggaggaaggtggggacgacgtcaagtcatcatgccccttatgacctgggctacacacgtgctacaatggacggtacaacgagtcgcaagaccgcgaggtttagctaatctcttaaagccgttctcagttcggattgtaggctgcaactcgcctacatgaagtcggaatcgctagtaatcgcgaatcagcatgtcgcggtgaatacgttcccgggccttgtacacaccgcccgtcacaccatgagagtttgtaacacccaaagccggtggggtaaccgcaaggagccagccgtctaaggtgggacagatgattggggtgaagtcgtaacaaggtagccgtaggagaacctgcggctggatcacctcctttctaaggaa

SEQ ID NO: 4883 - DNA, 1138 bp, Lactobacillus sp. UMNPBX3
  ref <308>: DATABASE ACCESSION NUMBER: NCBI ACCESSION: NZ_PCZG01000045.1
  ref <309>: DATABASE ENTRY DATE: 2019-04-01
  ref <313>: RELEVANT RESIDUES IN SEQ ID NO: (1)..(1138)
aagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaa

SEQ ID NO: 4884 - DNA, 1416 bp, Lactobacillus sp. UMNPBX5
  ref <308>: DATABASE ACCESSION NUMBER: NCBI ACCESSION: NZ_PCZE01000054.1
  ref <309>: DATABASE ENTRY DATE: 2019-04-01
  ref <313>: RELEVANT RESIDUES IN SEQ ID NO: (1)..(1416)
gggggataacatctggaaacaggtgctaataccgcataacaacgaaaaccacatggttttcgtttcaaagatggtttcggctatcacttcaggatgggcccgcggtgcattagctagttggtaaggtaacggcttaccaaggcaatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagggcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagttgcgaactcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatggaagtttgcaatgcccaaagtcggtggcctaaccatttggagggaaccgcctaaggcagggcagatgactggggtgaagtcgtaacaaggtagccgtaggagaacctgcggctggatcacctcctttctaaggaa

SEQ ID NO: 4885 - DNA, 1497 bp, Lactobacillus sp. UMNPBX7
  ref <308>: DATABASE ACCESSION NUMBER: NCBI ACCESSION: NZ_PCZC01000097.1
  ref <309>: DATABASE ENTRY DATE: 2019-04-01
  ref <313>: RELEVANT RESIDUES IN SEQ ID NO: (1)..(1497)
gggtgcttgcacctgattgacgatggattaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcggggacgcaatgacaggtggtgcatggtcgtcgtcagctcgtgtcgtgagatgttgggttaagtcccgcaacgagcgcaacccttgttactagttgccagcattaagttgggcactctagtgagactgccggtgacaaaccggaggaaggtggggacgacgtcagatcatcatgccccttatgacctgggctacacacgtgctacaatggacggtacaacgagtcgcaagctcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaa

SEQ ID NO: 4886 - DNA, 1570 bp, Lactobacillus sp. UMNPBX9; identical to SEQ ID NO: 4882
  ref <308>: DATABASE ACCESSION NUMBER: NCBI ACCESSION: NZ_PCZA01000079.1
  ref <309>: DATABASE ENTRY DATE: 2019-04-01
  ref <313>: RELEVANT RESIDUES IN SEQ ID NO: (1)..(1570)

SEQ ID NO: 4887 - DNA, 1581 bp, Lactobacillus sp. ZW163
  ref <308>: DATABASE ACCESSION NUMBER: NCBI ACCESSION: NZ_RRYD01000056.1
  ref <309>: DATABASE ENTRY DATE: 2019-04-01
  ref <313>: RELEVANT RESIDUES IN SEQ ID NO: (1)..(1581)
ttaatttgagagtttgatcctggctcaggatgaacgctggcggcgtgcctaatacatgcaagtcgaacgaacttaacttaatgaacggagtgcttgcacgaagtgatttaagagcggtgagtggcggatgggtgagtaacacgtgggtaacctgccttctagcaggggataacatctggaaacaggtgctaataccgtataaatctcaaaaccgcatggttttgagctgaaaggcggcttcggctgtcactagaagatggacccgcggtgcattagttagttggtgaggtaaaggcccaccaagactgtgatgcatagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaagctctgttgttggagaagaacactagtgagagtaactgttcattagttgacggtatccaaccagaaagccacggctaactacgtgccagcagccgcggtaatacgtaggtggcgagcgttatccggatttattgggcgtaaagcgagcgcaggcggttttttaagtctgatgtgaaagcccccggctcaaccggggaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatactaagtgttggagggtttccgcccttcagtgctgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgccaacccaagagattgggcgttcccttcggggacagaatgacaggtggtgcatggttgtcgtcagctcgtgtcgtgagatgttgggttaagtcccgcaacgagcgcaacccttatgactagttgccagcattcagttgggcactctagtaagactgccggtgacaaaccggaggaaggtggggacgacgtcaaatcatcatgccccttatgacctgggctacacacgtgctacaatggccggtacaacgagtcgccaacccgcgagggtgcgctaatctcttaaagccggtctcagttcggactgcaggctgcaactcgcctgcacgaagtcggaatcgctagtaatcgcggatcagcatgccgcggtgaatacgttcccgggccttgtacacaccgcccgtcacaccatgagagtttgtaacacccgaagccggtggggtaacccttttagggagctagccgtctaaggtgggacagatgattagggtgaagtcgtaacaaggtagccgtaggagaacctgcggctggatcacctcctttctaagga

SEQ ID NO: 4888 - DNA, 1579 bp, Lactobacillus sp. chh01
  ref <308>: DATABASE ACCESSION NUMBER: NCBI ACCESSION: NZ_MSSM01000072.1
  ref <309>: DATABASE ENTRY DATE: 2019-04-01
  ref <313>: RELEVANT RESIDUES IN SEQ ID NO: (1)..(1579)
tttatatgagagtttgatcctggctcaggatgaacgctggcggcgtgcctaatacatgcaagtcgaacgagttttggtcgatgaacggtgcttgcactgtgattcaacttaaaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggcgatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggggcaaaatgacaggtggtgcatggttgtcgtcagctcgtgtcgtgagatgttgggttaagtcccgcaacgagcgcaacccttatgactagttgccagcatttagttgggcactctagtaagactgccggtgacaaaccggaggaaggtggggatgacgtcaaatcatcatgccccttatgacctgggctacacacgtgctacaatggatggtacaacgagttgcgagaccgcgaggttaagctaatctcttaaagccattctcagttcggactgtaggctgcaactcgcctacacgaagtcggaatcgctagtaatcgcggatcagcacgccgcggtgaatacgttcccgggccttgtacacaccgcccgtcacaccatgagagtttgtaacacccgaagccggtggcgtaacccttttagggagcgagccgtctaaggtgggacaaatgattagggtgaagtcgtaacaaggtagccgtaggagaacctgcggctggatcacctcctttctaaggaa

SEQ ID NO: 4889 - DNA, 1574 bp, Lactobacillus sp. wkB10
  ref <308>: DATABASE ACCESSION NUMBER: NCBI ACCESSION: NZ_JRJB01000027.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaatcttaacggaatacttcggtaggaagtcaagagcgcgagcggcggatgggtgagtaacacgtgggcaacctgccctatagcttgggataccacttggaaacaggtgctaataccaaataagcagcgagagcgcatgctcaagctgggaaaggcggctttaaagctgtcactaaaggatgggcccgcggtgcattagctagttggcaaggtaacggcctaccaaggcgatgatgcatagccgagttgagagactgaccggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacaggggtagtaactgattcttgtttgacggtaatcaaccagaaagtcacggctaactacgtgccagcagccgcggtaatacgtaggtggcaagcgttgtccggatttattgggcgtaaagcgaacgcaggcgggagaataagtcagctgtgaaagccctcagcttaactggggaactgcagctgaaactatttttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgccagtcctagagataggatgtttccttcgggaacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgagcagcgaacctgcaaaggcaagcgaatctctgaaagctaatctcagttcggattgcactctgcaactcgagtgcatgaagctggaatcgctagtaatcgcggatcagcacgccgcggtgaatacgttcccgggccttgtacacaccgcccgtcacaccatgagagtctgtaatgcccaaagccggtaggataacctgcaaaggagtcagccgtctaaggcaggacagatgattagggtgaagtcgtaacaaggtagccgtaggagaacctgcggctggatcacctcctttctaaggaa

SEQ ID NO: 4890 - DNA, 1574 bp, Lactobacillus sp. wkB8
  ref <308>: DATABASE ACCESSION NUMBER: NCBI ACCESSION: NZ_CP009531.1
  ref <309>: DATABASE ENTRY DATE: 2019-04-01
  ref <313>: RELEVANT RESIDUES IN SEQ ID NO: (1)..(1574)
aaaaatgagagtttgatcctggctcaggacgaacgctggcggcgtgcctaatacatgcaagtcgagcgagcaattttgayrgaatacttcggtaggaagtcagaagcgcgagcggcggatgggtgagtaacacgtgggcaacctgccctttagcttgggataccacttggaaacaggtgctaataccaaataagcagcacgagcgcatgctcragctgagaaaggcggctttcgagctgtcactaaaggatgggcccgcggtgcattagctagttggtaaggtaacggcttaccaaggcgatgatgcatagccgagttgagagactgaccggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggacaagggtagtaactgattcttgtttgacggtaatcaaccagaaagtcacggctaactacgtgccagcagccgcggtaatacgtaggtggcaagcgttgtccggatttattgggcgtaaagcgaacgcaggcgggagaataagtcagctgtgaaagcccccagcttaactggggaactgcaactgaaactatttttcttgagtgcagaagaggagagtggaactccatgtgtagcggtggaatgcgtagatatatggaagaacaccagtggcgaaggcggctctctggtctgtaactgacgctgaggttcgaaagcatgggtagcgaacaggattagataccctggtagtccatgccgtaaacgatgagtgctaagtgttgggaggyttccgcctctcagtgctgcagctaacgcattaagcactccgcctggggagtacgaccgcaaggttaaaactcaaaggaattgacgggggcccgcacaagcggtggagcatgtggtttaattcgaagcaacgcgaagaaccttaccaggtcttgacatctagtgccagtcctagagataggatgtttccttcgggaacactaagacaggtggtgcatggctgtcgtcagctcgtgtcgtgagatgttgggttaagtcccgcaacgagcgcaacccttattattagttgccagcattaagttgggcactctaatgagactgccggtgacaaaccggaggaaggtggggacgacgtcaagtcatcatgccccttatgacctgggctacacacgtgctacaatggttagtacaacgagcagcgaacctgcaaaggcaagcgaatctctgaaagctaatctcagttcggattgcactctgcaactcgagtgcatgaagctggaatcgctagtaatcgcggatcagcacgccgcggtgaatacgttcccgggccttgtacacaccgcccgtcacaccatgagagtctgtaatgcccaaagccggtaggataacctgcaaaggagtcagccgtctaaggcaggacagatgattagggtgaagtcgtaacaaggtagccgtaggagaacctgcggctggatcacctcctttctaaggaa

SEQ ID NO: 4891 - DNA, 1575 bp, Lactobacillus spicheri
  ref <308>: DATABASE ACCESSION NUMBER: NCBI ACCESSION: NZ_AZFC01000009.1
  ref <309>: DATABASE ENTRY DATE: 2019-04-01
  ref <313>: RELEVANT RESIDUES IN SEQ ID NO: (1)..(1575)
ttaagatgagagtttgatcctggctcaggacgaacgctggcggcatgcctaatacatgcaagtcgaacgagttcccgttgattgacgtgcttgcactgatttcaacattggaacgagtggcgaactggtgagtaacacgtgggaaatctgcccagaagcaggggataacacttggaaacaggtgctaataccgtataacaacaaaatccgcatggattttgtttgaaaggtggtttcggctatcacttctggatgatcccgcggcgtattagttagttggtagggtaatggcttaccaagacgatgatacgtagccgacctgagagggtaatcggccacattgggactgagacacggcccagactcctacgggaggcagcagtagggaatcttccacaatggacgaaagtctgatggagcaatgccgcgtgagtgaagaagggtttcggctcgtaaaactctgttgttgaagaagaacgggtgtcagagtaactgttgacatcgtgacggtattcaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccgaagaagtgcatcggaaactgggagacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatctaagagattagacgttcccttcggggacagaatgacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggacggtacaacgagtcgcaaagtcgcgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4892 - DNA, 1566 bp, Lactobacillus sucicola
  ref <308>: DATABASE ACCESSION NUMBER: NCBI ACCESSION: NZ_AYZF01000006.1
  ref <309>: DATABASE ENTRY DATE: 2019-04-01
  ref <313>: RELEVANT RESIDUES IN SEQ ID NO: (1)..(1566)
taaaatgagagtttgatcctggctcaggacgaacgctggcggcgtgcctaatacatgcaagtcgtacgcaaaactttctctgagtgttcgcactcgctgaaagatttgagtggcgaacgggtgagtaacacgtgggtaacctgcccagaagaaggggataacacttggaaacaggtgctaataccgtataacaacaaagaccgcatggtctttgtttaaaagatggttctgctatcacttctggatggacccgcggcgtattagctagttggtgaggtaatggctcaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtgtgtgagagtaactgttcatgcagtgacggtatctaaccagaaagccacggctaactacgtgccagcagccgcggtaatacgtaggtggcaagcgttgtccggatttattgggcgtaaagggaacgcaggcggttttttaagtctgatgtgaaagccttcggcttaaccgaagtcgtgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcatgggtagcaaacaggattagataccctggtagtccatgccgtaaacgatgaatgctaagtgttggagggtttccgcccttcagtgctgcagctaacgcattaagcattccgcctggggagtacgatcgcaagattgaaactcaaaggaattgacgggggcccgcacaagcggtggagcatgtggtttaattcgaagcaacgcgaagaaccttaccaggtcttgacatcttctgccaatctgagagatcagatgttcccttcggggacagaatgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgacctgggctacacacgtgctacaatggacagtacaacgagtcgcaagaccgcgaggtcaagctaatctcttaaagctgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtgaggtaaccttttggagccagccgtctaaggtgggacagatgattggggtgaagtcgtaacaaggtagccgtaggagaacctgcggctggatcacctcctttctaagga

SEQ ID NO: 4893 - DNA, 1585 bp, Lactobacillus suebicus
  ref <308>: DATABASE ACCESSION NUMBER: NCBI ACCESSION: NZ_AZGF01000056.1
  ref <309>: DATABASE ENTRY DATE: 2019-04-01
  ref <313>: RELEVANT RESIDUES IN SEQ ID NO: (1)..(1585)
ttatatgagagtttgatcctggctcaggatgaacgctggcggtgtgcctaatacatgcaagtcgtacgcattctcgtttctgattgacggtgcttgcacctaattgacgagacattggaatgagtggcggacgggtgagtaacacgtgggtaacctgcccagaagtgggggataacatttggaaacagatgctaataccgcataaaagtcaaaaccacatggttttgatttaaaagatggcctttgtgctatcacttctggatggacccgcggcgtattagctagttggtaaggtaacggcttaccaaggcaatgatacgtagccgaactgagaggttgatcggccacaatgggactgagacacggcccatactcctacgggaggcagcagtagggaatcttccacaatgggcgcaagcctgatggagcaacaccgcgtgagtgaagaagggtttcggctcgtaaaactctgttgttaaagaagaacgtatctaagagtaactgcttaggtagtgacggtatttaaccagaaagccacggctaactacgtgccagcagccgcggtaatacgtaggtggcaagcgttatccggatttattgggcgtaaagcgagcgcaggcggttttttaagtctgatgtgaaagccttcggcttaaccgaagaagtgcatcggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatctagcgccaatctcagagatgagacgttcccttcggggacgctaagacaggtggtgcatggttgtcgtcagctcgtgtcgtgagatgttgggttaagtcccgcaacgagcgcaacccttattatcagttgccagcatttagttgggcactctggtgagactgccggtgacaaaccggaggaaggtggggacgacgtcaaatcatcatgccccttatgacctgggctacacacgtgctacaatggacggtacaacgagttgcgaactcgcgagggtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttctaaggaa

SEQ ID NO: 4894 - DNA, 1584 bp, Lactobacillus sunkii
  ref <308>: DATABASE ACCESSION NUMBER: NCBI ACCESSION: NZ_MIQE01000038.1
  ref <309>: DATABASE ENTRY DATE: 2019-04-01
  ref <313>: RELEVANT RESIDUES IN SEQ ID NO: (1)..(1584)
ttaagatgagagtttgatcctggctcaggacgaacgctggcggcgtgcctaatacatgcaagtcgaacgcgtcttggttattgatttcaggtgcttgcacttgaatgatttaacattgagacgagtggcgaactggtgagtaacacgtgggtaacctgcccttgaagtaggggataacacttggaaacaggtgctaataccgtataacaaccaaaaccacatggttttggtttaaaagatggtttcggctgtcactttaggatggacccgcggcgtattagcttgttggtaaggtaacggcctaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgatgaagggtttcggctcgtaaaactctgttgttggagaagaacaggtgtcagagtaactgttgacatcttgacggtatccaaccagaaagccacggctaactacgtgccagcagccgcggtaatacgtaggtggcaagcgttgtccggatttattgggcgtaaagcgagcgcaggcggtttcttaggtctgatgtgaaagccttcggcttaaccggagaagtgcatcggaaaccaggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgatgctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggtggggatgacgtcaaatcatcatgccccttatgacctgggctacacacgtgctacaatggacggtacaacgagtcgcgaaaccgcgaggtcaagctaatctcttaaagccgttctcagttcggattgtaggctgcaactcgcctacatgaagttggaatcgctagtaatcgtggatcagcatgccacggtgaatacgttcccgggccttgtacacaccgcccgtcacaccatgagagtttgtaacacccaaagccggtgaggtaaccttcggggaccagccgtctaaggtgggacagatgattagggtgaagtcgtaacaaggtagccgtaggagaacctgcggctggatcacctcctttctaaggaa

SEQ ID NO: 4895 - DNA, 1583 bp, Lactobacillus terrae
  ref <308>: DATABASE ACCESSION NUMBER: NCBI ACCESSION: NZ_CP024610.1
  ref <309>: DATABASE ENTRY DATE: 2019-04-01
  ref <313>: RELEVANT RESIDUES IN SEQ ID NO: (1)..(1583)
ctaatatgagagtttgatcctggctcaggacgaacgctggcggcgtgcctaatacatgcaagtcgagcgaactctcgtgaatgatcaatggtgcttgcaccagagagatttcacatttgagtgagcggcggacgggtgagtaacacgtgggtaacctaccctaaagagggggataacatctggaaacaggtgctaataccgcataacaatttcttccgcatggttgaaatttaaaagatggttttgctatcactttaggatggacccgcggcgtattagctagttggtgaggtaacggctcaccaaggcgatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcatgagagtaactgttcatgtattgacggtattcaaccagaaagccacggctaactacgtgccagcagccgcggtaatacgtaggtggcaagcgttgtccggatttattgggcgtaaagcgagtgcaggcggtttattaagtctgatgtgaaagccctcggctcaaccgaggaattgcatcggaaactggtaaacttgagtgcagaagaggagagtggaactccatgtgtagcggtggaatgcgtagatatatggaagaacaccagtggcgaaggcggctctctggtctgtaactgacgctgaggctcgaaagtgtgggtagcaaacaggattagataccctggtagtccacaccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccatgaaagtctaagagattagaggttcccttcggggacatggatacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggacgacgtcaaatcatcatgccccttatgacctgggctacacacgtgctacaatggtcagtacaacgtgctgcgaactcgcgagggtaagcaaatcacttaaaactgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacagatgattagggtgaagtcgtaacaaggtagccgtaggagaacctgcggctggatcacctcctttctaaggaa

SEQ ID NO: 4896 - DNA, 1581 bp, Lactobacillus thailandensis
  ref <308>: DATABASE ACCESSION NUMBER: NCBI ACCESSION: NZ_AYZK01000017.1
  ref <309>: DATABASE ENTRY DATE: 2019-04-01
  ref <313>: RELEVANT RESIDUES IN SEQ ID NO: (1)..(1581)
tttatatgagagtttgatcctggctcaggatgaacgctggcggcgtgcctaatacatgcaagtcgagcgaacttaactaaatgaatgcggtgcttgcaccaagtgattttagagcggtgagcggcggatgggtgagtaacacgtgggtaacctgcctctaagcaggggataacatttggaaacagatgctaataccgtataaatcctcaaaccacatggtttgaggctgaaaggcggcttcggctgtcacttagagatggacccgcggcgtattagctagttggtgaggtaatggctcaccaaggcaatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttgaagaagaacacgtttgagagtaactgttcagacgttgacggtattcaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagtgcatcggaaactgggaaacttgaatgctgaagaggacagtggaactccatgtgtagcggtgaaatgcgtagatatatggaagaacaccagtggcgaaggcggctgtctggtcagttattgacgctgaggctcgaaagcatgggtagcgaacaggattagataccctggtagtccatgccgtaaacgatgaatactaggtgttggagggtttccgcccttcagtgccgcagctaacgcattaagtattccgcctggggagtacgaccgcaaggttgaaactcaaaggaattgacgggggcccgcacaagcggtggagcatgtggtttaattcgaagcaacgcgaagaaccttaccaggtcttgacatcttctgctatttctagagatagaaagttcccttcggggacggaatgacaggtggtgcatggttgtcgtcagctcgtgtcgtgagatgttgggttaagtcccgcaacgagcgcaacccttatgactagttgccagcattaagttgggcactctagtaagactgccggtgacaaaccggaggaaggtggggacgacgtcaaatcatcatgccccttatgacctgggctacacacgtgctacaatggttggtacaacgagttgcgaacccgcgagggcaagctaatctcttaaagccaatctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagccggtggggcaacccttcggggagctagccgtctaaggtgggacagatgattagggtgaagtcgtaacaaggtagccgtaggagaacctgcggctggatcacctcctttctaaggaa

SEQ ID NO: 4897 - DNA, 1236 bp, Lactobacillus timberlakei
  ref <308>: DATABASE ACCESSION NUMBER: NCBI ACCESSION: NZ_POST01000001.1
  ref <309>: DATABASE ENTRY DATE: 2019-04-01
  ref <313>: RELEVANT RESIDUES IN SEQ ID NO: (1)..(1236)
ggggacgagtggcgaactggtgagtaacacgtgggtaacctgccctaaagcaggggataacatttggaaacagatgctaataccgtataattagttggaaccacatggttccaacttgaaagatggctctgctatcactttaggatggacccgcggcgtattagctagttggtgagataaaagctcaccaaggcgatgatacgtagccgacctgagagggtaatcggccacattgggactgagacacggcccagactcctacgggaggcagcagtagggaatcttccacaatggacgaaagtctgatggagcaacgccgcgtgagtgaagaagggtttcggctcgtaaaactctgttgttaaagaagaacaagtgtaagagtaactgtttacgctttgacggtatttaaccagaaagccacggctaactacgtgccagcagccgcggtaatacgtaggtggcaagcgttgtccggatttattgggcgtaaagcgagcgcaggtggtcttttaagtctgttgtgaaagccctcagctcaactgaggaagtgcagcggaaactaggagacttgagtacagaagaggatagtggaactccatgtgtagcggtgaaatgcgtagatatatggaagaacaccagtggcgaaggcggctatctggtctgttactgacactgaggctcgaaagcatgggtagcgaacaggattagataccctggtagtccaygccgtaaacgatgartgctaagtgttgggaggtttccgcctctcagtgctgcagctaacgcattaagyaytccgcctggggagtacgrccgcaaggttaaaactcaaakgaattgacgggggcccgcacaagcggtggagcatgtggtttaattcgawgcaacgcgaagaaccttaccwgstcttgacatctastgcmarycywagagatwrgrcgttyccttcgggracastaagacaggtgstgcatggctgtcgtcagctcgtgtygtgaratgttgggttaagtcccgcaacgagcgcaacccttattattagttgccagcattaagttgggcactctagtgagactgccggtgataaaccggaggaaggtggggatgacgtcaaatcatcatgccccttatgacctgggctacacacgtgctacaatggatggtacaacgagtcgcgaaaccgcgaggtcaagctaatctcttaaagccattctcagttcggattgcaggctgcaa

SEQ ID NO: 4898 - DNA, 1583 bp, Lactobacillus timonensis
  ref <308>: DATABASE ACCESSION NUMBER: NCBI ACCESSION: NZ_LT964761.1
  ref <309>: DATABASE ENTRY DATE: 2019-04-01
  ref <313>: RELEVANT RESIDUES IN SEQ ID NO: (1)..(1583)
taatatgagagtttgatcctggctcaggatgaacgccggcggtgtgcctaatacatgcaagtcgaacgcactggcccaactgagatgacgtgcttgcactgatttgacgatggattaccagtgagtggcggacgggtgagtaacacgtaggcaacctgcccaagagcgggggataacatttggaaacaagtgctaataccgcataagattgatgaccacatggtcatcaatttaaagatggtttcggctatcactcttggatgggcctgcggtgcattagctagttggtaaggtaacggcttaccaaggcagtgatgcatagccgagttgagagactgatcggccacaatgggactgagacacggcccatactcctacgggaggcagcagtagggaatcttccacaatgggcgcaagcctgatggagcgacaccgcgtgagtgaagaagggtttcggctcgtaaagctctgttgttgaagaagaacgtgcgtgagagtaactgttcacgcagtgacggtattcaaccagaaagtcacggctaactacgtgccagcagccgcggtaatacgtaggtggcaagcgttatccggatttattgggcgtaaagcgagcgcaggcggttttctaagtctgatgtgaaagccttcggcttaaccgaagaagggcatcggaaactggatgacttgagtgcagaagagggcagtggaactccatgtgtagcggtggaatgcgtagatatatggaagaacaccagtggcgaaggcggctgcctagtctgcaactgacgctgaggctcgaaagcatgggtagcgaacaggattagataccctggtagtccatgccgtaaacgatgagtgctaggtgttggagggtttccgcccttcagtgccgcagctaacgcaataagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagcagcgaactcgcgagggcaagcaaatctcttaaaaccgttctcagttcggactgtaggctgcaactcgcctacacgaagtcggaatcgctagtaatcgcggatcagcatgccgcggtgaatacgttcccgggccttgtacacaccgcccgtcacaccatggaagtttgcaatgcccaaagtcggtgggctaaccttcgggaagcagccgcctaaggcagggcagatgactggggtgaagtcgtaacaaggtagccgtaggagaacctgcggctggatcacctcctttctaaggaa

SEQ ID NO: 4899 - DNA, 1583 bp, Lactobacillus tucceti
  ref <308>: DATABASE ACCESSION NUMBER: NCBI ACCESSION: NZ_AZDG01000033.1
  ref <309>: DATABASE ENTRY DATE: 2019-04-01
  ref <313>: RELEVANT RESIDUES IN SEQ ID NO: (1)..(1583)
ttaatatgagagtttgatcctggctcaggacgaacgctggcggcgtgcctaatacatgcaagtcgagcgaactctggtaactgaacgatggtgcttgcaccggagtgatgatacatttgagtgagcggcggatgggtgagtaacacgtgggtaacctgccctaaagtgggggataacatctggaaacaggtgctaataccgcataacaacatttaccacatggtttatgtttgaaagatggttctgctatcgctttaggatggacccgcggcgtattagctagttggtgaggtaacggctcaccaaggcaatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttgtccggatttattgggcgtaaagcgagcgtaggcggtttattaagtctgatgtgaaagccctcggctcaaccgaggaagtgcatcggaaactggtaaacttgagtgcagaagaggaaagtggaactccatgtgtagcggtggaatgcgtagatatatggaagaacaccagtggcgaaggcggctttctggtctgtaactgacgctgaggttcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatatcttgaaagtctaagagattagaggttcccttcggggacaagaatacaggtggtgcatggttgtcgtcagctcgtgtcgtgagatgttgggttaagtcccgcaacgagcgcaacccttattactagttgccagcattaagttgggcactctagtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgcaggctgcaactcgcctgcatgaagctggaatcgctagtaatcgtggatcagcatgccacggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaaggaa

SEQ ID NO: 4900 - DNA, 1574 bp, Lactobacillus ultunensis
  ref <308>: DATABASE ACCESSION NUMBER: NCBI ACCESSION: NZ_AZFO01000071.1
  ref <309>: DATABASE ENTRY DATE: 2019-04-01
  ref <313>: RELEVANT RESIDUES IN SEQ ID NO: (1)..(1574)
tttaaaatgagagtttgatcctggctcaggacgaacgctggcggcgtgcctaatacatgcaagtcgagcgagcggaaccagcagatctgcttcggcagtgacgctgggaaagcgagcggcggatgggtgagtaacacgtggggaacctgccccaaagtctgggataccacttggaaacaggtgctaataccggataagaaagcagatcgcatgatcagcttttaaaaggcggcgtaagctgtcgctatgggatggccccgcggtgcattagctagttggtagagtaacggcctaccaaggcaatgatgcatagccgagttgagagactgatcggccacattgggactgagacacggcccaaactcctacgggaggcagcagtagggaatcttccacaatggacgcaagtctgatggagcaacgccgcgtgagtgaagaaggttttcggatcgtaaagctctgttgttggtgaagaaggatagaggtagtaactggcctttatttgacggtaatcaaccagaaagtcacggctaactacgtgccagcagccgcggtaatacgtaggtggcaagcgttgtccggatttattgggcgtaaagcgagcgcaggcggaaaaataagtctaatgtgaaagccctcggcttaaccgaggaactgcatcggaaactgtttttcttgagtgcagaagaggagagtggaactccatgtgtagcggtggaatgcgtagatatatggaagaacaccagtggcgaaggcggctctctggtctgcaactgacgctgaggctcgaaagcatgggtagcgaacaggattagataccctggtagtccatgccgtaaacgatgagtgctaagtgttgggaggtttccgcctctcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatctagtgccatcttcagagatgaagagttcccttcggggacgctaagacaggtggtgcatggctgtcgtcagctcgtgtcgtgagatgttgggttaagtcccgcaacgagcgcaacccttgttattagttgccagcattaagttgggcactctaatgagactgccggtgacaaaccggaggaaggtggggatgacgtcaagtcatcatgccccttatgacctgggctacacacgtgctacaatgggcagtacaacgagaagcgagcctgcgaaggcaagcgaatctctgaaagctgttctcagttcggactgcagtctgcaactcgactgcacgaagctggaatcgctagtaatcgcggatcagcacgccgcggtgaatacgttcccgggccttgtacacaccgcccgtcacaccatgggagtctgcaacgcccaaagccggtggcctaaccgaaaggaaggagccgtctaaggcagggcagatgactggggtgaagtcgtaacaaggtagccgtaggagaacctgcggctggatcacctcctttctaaggaa

SEQ ID NO: 4901 - DNA, 1566 bp, Lactobacillus uvarum
  ref <308>: DATABASE ACCESSION NUMBER: NCBI ACCESSION: NZ_AZEG01000088.1
  ref <309>: DATABASE ENTRY DATE: 2019-04-01
  ref <313>: RELEVANT RESIDUES IN SEQ ID NO: (1)..(1566)
taaaatgagagtttgatcctggctcaggacgaacgctggcggcgtgcctaatacatgcaagtcgtacgcaaaactttcaccgagtgcttgcactcaccgaaagttttgagtggcgaacgggtgagtaacacgtgggtaacctgcccagaagaaggggataacacttggaaacaggtgctaataccgtataacaacaaagaccgcatggtctttgtttaaaagatggttctgctatcacttctggatggacccgcggcgtattagctagttggtgaggtaatggctcaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgttagagaagaacgtgtgtgagagtaactgttcatgcagtgacggtatctaaccagaaagccacggctaactacgtgccagcagccgcggtaatacgtaggtggcaagcgttgtccggatttattgggcgtaaagggaacgcaggcggttttttaagtctgatgtgaaagccttcggcttaaccgaagtcatgcattggaaactggaagacttgagtgcagaagaggagagtggaactccatgtgtagcggtgaaatgcgtagatatatggaagaacaccagtggcgaaagcggctctctggtctgtaactgacgctgaggttcgaaagcatgggtagcaaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgccaatctgagagatcagatgttcccttcggggacagaatgacaggtggtgcatggttgtcgtcagctcgtgtcgtgagatgttgggttaagtcccgcaacgagcgcaacccttattactagttgccagcatttagttgggcactctagtgagactgccggtgataaaccggaggaaggtggggatgacgtcaaatcatcatgccccttatgacctgggctacacacgtgctacaatggacagtacaacgagtcgcaagaccgcgaggtcaagctaatctcttaaagctgttctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagccggtgaggtaaccttttggagccagccgtctaaggtgggacagatgattggggtgaagtcgtaacaaggtagccgtaggagaacctgcggctggatcacctcctttctaagga

SEQ ID NO: 4902 - DNA, 1587 bp, Lactobacillus vaccinostercus
  ref <308>: DATABASE ACCESSION NUMBER: NCBI ACCESSION: NZ_AYYY01000028.1
  ref <309>: DATABASE ENTRY DATE: 2019-04-01
  ref <313>: RELEVANT RESIDUES IN SEQ ID NO: (1)..(1587)
tttatatgagagtttgatcctggctcaggatgaacgctggcggtgtgcctaatacatgcaagtcgtacgcattcccgtttttgattgaaggtgcttgcacctgattgataaaacatcggaatgagtggcggacgggtgagtaacacgtgggtaacctgcccagaagtgggggataacatttggaaacagatgctaataccgcataatagatagaaccacatggttctattttgaaagatggcctttgtgctatcacttctggatggacccgcggtgtattagctagttggtaaggtaacggcttaccaaggcaatgatacatagccgaactgagaggttgatcggccacaatgggactgagacacggcccatactcctacgggaggcagcagtagggaatcttccacaatgggcgcaagcctgatggagcaacaccgcgtgagtgaagaagggtttcggctcgtaaaactctgttgttaaagaagaacgtatctaagagtaactgcttaggtagtgacggtatttaaccagaaagccacggctaactacgtgccagcagccgcggtaatacgtaggtggcaagcgttatccggatttattgggcgtaaagcgagcgcaggcggttttttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaagtgttggagggtttccgcccttcagtgctgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatctagcgccaatctcagagatgagacgttcccttcggggacgctaagacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggacggtacaacgagttgcgaactcgcgagggtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagtcggtggggtaacccttcggggagccagccgcctaaggtgggacagatgattagggtgaagtcgtaacaaggtagccgtaggagaacctgcggctggatcacctcctttctaaggaa

SEQ ID NO: 4903 - DNA, 1031 bp, Lactobacillus vaginalis
  ref <308>: DATABASE ACCESSION NUMBER: NCBI ACCESSION: NZ_RJTI01000050.1
  ref <309>: DATABASE ENTRY DATE: 2019-04-01
  ref <313>: RELEVANT RESIDUES IN SEQ ID NO: (1)..(1031)
ggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagggcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaacctaagagattaggcgttcccttcggggacgcaatgacaggtggtgcatggtcgtcgtcagctcgtgtcgtgagatgttgggttaagtcccgcaacgagcgcaacccttgttactagttgccagcattcagttgggcactctagtgagactgccggtgacaaaccggaggaaggtggggacgacgtcagatcatcatgccccttatgacctgggctacacacgtgctacaatggacggtacaacgagttgcgaactcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatggaagtttgcaatgcccaaagtcggtggcctaaccattt

SEQ ID NO: 4904 - DNA, 1281 bp, Lactobacillus versmoldensis
  ref <308>: DATABASE ACCESSION NUMBER: NCBI ACCESSION: NZ_AZFA01000051.1
  ref <309>: DATABASE ENTRY DATE: 2019-04-01
  ref <313>: RELEVANT RESIDUES IN SEQ ID NO: (1)..(1281)
ccaagacgatgatacgtagccgacctgagagggtaatcggccacattgggactgagacacggcccaaactcctacgggaggcagcagtagggaatcttccacaatggacgaaagtctgatggagcaacgccgcgtgagtgaagaaggttttcggatcgtaaaactctgttgttgaagaagaacatgcgtgagagtaactgttcatgtattgacggtattcaaccagaaagccacggctaactacgtgccagcagccgcggtaatacgtaggtggcaagcgttatccggatttattgggcgtaaagcgagtgcaggcggtttattaggtctgatgtgaaagccctcggctcaaccgaggaagtgcatcggaaaccggtaaacttgagtgcagaagaggagagtggaactccatgtgtagcggtggaatgcgtagatatatggaagaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccatgaaaagctaagagattagtctttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggacgacgtcaaatcatcatgccccttatgacctgggctacacacgtgctacaatggtcggtacaacgtgttgcgaactcgcgagggcaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacaaatgattagggtgaagtcgtaacaaggtagccgtaggagaacctgcggctggatcacctcctttctaaggaa

SEQ ID NO: 4905 - DNA, 1565 bp, Lactobacillus vini
  ref <308>: DATABASE ACCESSION NUMBER: NCBI ACCESSION: NZ_AYYX01000149.1
  ref <309>: DATABASE ENTRY DATE: 2019-04-01
  ref <313>: RELEVANT RESIDUES IN SEQ ID NO: (1)..(1565)
taaaatgagagtttgatcctggctcaggacgaacgctggcggcgtgcctaatacatgcaagtcgaacgagactttttatttgatgcttgcatcttttaaaaagttgagtggcgaacgggtgagtaacacgtgggtaacctgccttaaagtgggggataacacttggaaacaggtgctaataccgcataaccatcaaaaccgcctggttttgatgttaaagatggttctgctatcgctttaagatggacccgcggcgtattagctagttggtgaggtaacggcttaccaaggcaatgatacgtagccgaactgagaggttgatcggccacattgggactgagacacggcccaaactcctacgggaggcagcagtagggaatcttccacaatggacgaaagtctgatggagcaacgccgcgtgagtgaagaaggttttcggatcgtaaaactctgttgtcagagaagaacgtgtgtgagagtaactgttcacgcagtgacggtatctgaccagaaagtcacggctaactacgtgccagcagccgcggtaatacgtaggtggcaagcgttgtccggatttattgggcgtaaagggaacgcaggcggtcttttaagtctgatgtgaaagccttcggcttaaccgaagtcgggcattggaaactgggagacttgagtgcagaagaggagagtggaactccatgtgtagcggtgaaatgcgtagatatatggaagaacaccagtggcgaaagcggctctctggtctgtaactgacgctgaggttcgaaagcgtgggtagcaaacaggattagataccctggtagtccacgccgtaaacgatgaatgctaagtgttggagggtttccgcccttcagtgccgcagctaacgcattaagcattccgcctggggagtacgatcgcaagattgaaactcaaaggaattgacgggggcccgcacaagcggtggagcatgtggtttaattcgaagcaacgcgaagaaccttaccaggtcttgacatcttttgctaacctgagagatcaggtgttcccttcggggacaaaatgacaggtggtgcatggttgtcgtcagctcgtgtcgtgagatgttgggttaagtcccgcaacgagcgcaacccttattgttagttgccagcatttagttgggcactctaacgagactgccggtgacaaaccggaggaaggtggggatgacgtcaaatcatcatgccccttatgacctgggctacacacgtgctacaatggacggtacaacgagtcgcaagaccgcgaggtcaagctaatctctgaaaaccgttctcagttcggattgcaggctgcaactcgcctgcatgaagtcggaatcgctagtaatcgcggatcagcatgccgcggtgaatacgttcccgggccttgtacacaccgcccgtcacaccatgagagtttgtaacacccaaagccggtggggtaacctttgggagccagccgtctaaggtgggacagatgattggggtgaagtcgtaacaaggtagccgtaggagaacctgcggctggatcacctcctttctaaggaa

SEQ ID NO: 4906 - DNA, 1583 bp, Lactobacillus wasatchensis
  ref <308>: DATABASE ACCESSION NUMBER: NCBI ACCESSION: NZ_AWTT01000084.1
  ref <309>: DATABASE ENTRY DATE: 2019-04-01
  ref <313>: RELEVANT RESIDUES IN SEQ ID NO: (1)..(1583)
tatatgagagtttgatcctggctcaggatgaacgctggcggtgtgcctaatacatgcaagtcgaacgcattctcgtttttgattgacggtgcttgcaccagattgagagaacatttgaatgagtggcggacgggtgagtaacacgtggataacctgcccagaagtgggggataacatttggaaacagatgctaataccgcataaaagtcaaaaccacatggttttgatttaaaagatggccttgtgctatcacttttggatggatccgcggtgtattagctagttggtaaggtaaaggcttaccaaggcaatgatacatagccgaactgagaggttgatcggccacaatgggactgagacacggcccatactcctacgggaggcagcagtagggaatcttccacaatggacgaaagtctgatggagcaacaccgcgtgagtgaagaagggtttcggctcgtaaaactctgttgttggagaagaacgtatgtgatagtaactgatcatgtagtgacggtatccaaccagaaagccacggctaactacgtgccagcagccgcggtaatacgtaggtggcaagcgttatccggatttattgggcgtaaagcgagcgcaggcggttttttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcggtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatctagcgccaatctcagagatgagacgttcccttcggggacgctaagacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggacgacgtcaaatcatcatgccccttatgacctgggctacacacgtgctacaatggacggtacaacgagttgcgaactcgcgagggtaagctaatctcttaaaaccgttctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagtcggtggggtaaccttttaggagccagccgcctaaggtgggacagatgattagggtgaagtcgtaacaaggtagccgtaggagaacctgcggctggatcacctcctttctaaggaa

SEQ ID NO: 4907 - DNA, 1575 bp, Lactobacillus xiangfangensis
  ref <308>: DATABASE ACCESSION NUMBER: NCBI ACCESSION: NZ_JQCL01000078.1
  ref <309>: DATABASE ENTRY DATE: 2019-04-01
  ref <313>: RELEVANT RESIDUES IN SEQ ID NO: (1)..(1575)
ttaatttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagtgggggataacacctggaaacagatgctaataccgcataacaactcggaccgcatggtctgagtttgaaagatggcttcggctatcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactacgctaacctgagagatcaggcgttcccttcggggacgtggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagcaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttcggggaccagccgcctaaggtgggacagatgattagggtgaagtcgtaacaaggtagccgtaggagaacctgcggctggatcacctcctttctaaggaa

SEQ ID NO: 4908 - DNA, 1575 bp, Lactobacillus yonginensis
  ref <308>: DATABASE ACCESSION NUMBER: NCBI ACCESSION: NZ_RHNO01000045.1
  ref <309>: DATABASE ENTRY DATE: 2019-04-01
  ref <313>: RELEVANT RESIDUES IN SEQ ID NO: (1)..(1575)
ttaagatgagagtttgatcctggctcaggacgaacgctggcggcatgcctaatacatgcaagtcgaacgagcttccgttgattgacgtgcttgcactgatttcaacattgaagcgagtggcgaactggtgagtaacacgtgggaaatctgcccagaagcaggggataacacttggaaacaggtgctaataccgtataacaacaaaaaccgcatggtttttgtttgaaaggtggcttcggctatcacttctggatgatcccgcggcgtattagttagttggtgaggtaaaggcccaccaagacaatgatacgtagccgacctgagagggtaatcggccacattgggactgagacacggcccaaactcctacgggaggcagcagtagggaatcttccacaatggacgaaagtctgatggagcaatgccgcgtgagtgaagaagggtttcggctcgtaaaactctgttgttaaagaagaacacttctgagagtaactgttcagaagttgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggcttaaccggagaagtgcatcggaaactgggaaacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaggtgttggagggtttccgcccttcagtgccgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatactatgcaaatcttagagataagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggacggtacaacgagttgcgaagtcgtgaggctaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtgagataaccttcgggagtcagccgtctaaggtgggacagatgattagggtgaagtcgtaacaaggtagccgtaggagaacctgcggctggatcacctcctttctaaggaa

SEQ ID NO: 4909 - DNA, 1062 bp, Lactobacillus zeae
  ref <308>: DATABASE ACCESSION NUMBER: NCBI ACCESSION: NZ_AZCT01000047.1
  ref <309>: DATABASE ENTRY DATE: 2019-04-01
  ref <313>: RELEVANT RESIDUES IN SEQ ID NO: (1)..(1062)
tttatatgagagtttgatcctggctcaggatgaacgctggcggcgtgcctaatacatgcaagtcgaacgagttttggtcgatgaacggtgcttgcatcgtgattcaacttaaaacgagtggcggacgggtgagtaacacgtgggtaacctgcccttaagtgggggataacatttggaaacagatgctaataccgcataaatccaagaaccgcatggttcttggctgaaagatggcgtaagctatcgcttttggatggacccgcggcgtattagctagttggtgaggtaacggctcaccaaggccatgatacgtagccgaactgagaggttgatcggccacattgggactgagacacggcccaaactcctacgggaggcagcagtagggaatcttccacaatggacgcaagtctgatggagcaacgccgcgtgagtgaagaaggctttcgggtcgtaaaactctgttgttggagaagaatggtcggcagagtaactgttgtcggcgtgacggtatccaaccagaaagccacggctaactacgtgccagcagccgcggtaatacgtaggtggcaagcgttatccggatttattgggcgtaaagcgagcgcaggcggttttttaagtctgatgtgaaagccctcggcttaaccgaggaagcgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgaatgctaggtgttggagggtttccgcccttcagtgccgcagctaacgcattaagcattccgcctggggagtacgaccgcaaggttgaaactcaaaggaattgacgggggcccgcacaagcggtggagcatgtggtttaattcgaagcaacgcgaagaaccttaccaggtcttgacatcttttgatcacctgagagatcaggtttccccttcgggg

SEQ ID NO: 4910 - DNA, 1575 bp, Lactobacillus zymae
  ref <308>: DATABASE ACCESSION NUMBER: NCBI ACCESSION: NZ_LT854705.1
  ref <309>: DATABASE ENTRY DATE: 2019-04-01
  ref <313>: RELEVANT RESIDUES IN SEQ ID NO: (1)..(1575)
ttaagatgagagtttgatcctggctcaggacgaacgctggcggcatgcctaatacatgcaagtcgaacgagttcccgttgattgacgtgtttgcactgatttcaacattggaacgagtggcgaactggtgagtaacacgtggaaaacctgcccagaagcaggggataacacttggaaacaggtgctaataccgtataacaacaaaaaccgcatggtttttgtttgaaaggtggcttcggctatcacttctggatggttccgcggcgcattagctagttggtgaggtaaaggcccaccaaggcaatgatgcgtagccgacctgagagggtaatcggccacattgggactgagacacggcccagactcctacgggaggcagcagtagggaatcttccacaatggacgaaagtctgatggagcaatgccgcgtgagtgaagaagggtttcggctcgtaaaactctgttgttgaagaagaacgggtgtcagagtaactgttgacatcgtgacggtattcaaccagaaagccacggctaactacgtgccagcagccgcggtaatacgtaggtggcaagcgttgtccggatttattgggcgtaaagcgagcgcaggcggttatttaagtctgatgtgaaagccttcggcttaaccgaagaagtgcatcggaaactgggtaacttgagtgcagaagaggacagtggaactccatgtgtagcggtggaatgcgtagatatatggaagaacaccagtggcgaaggcggctgtctagtctgtaactgacgctgaggctcgaaagcatgggtagcgaacaggattagataccctggtagtccatgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttctgccaatcttagagataagacgttcccttcggggacagaatgacaggtggtgcatggttgtcgtcagctcgtgtcgtgagatgttgggttaagtcccgcaacgagcgcaacccttattatcagttgccagcattcagttgggcactctggtgagactgccggtgacaaaccggaggaaggtggggatgacgtcaaatcatcatgccccttatgacctgggctacacacgtgctacaatggacggtacaacgagttgcgaagtcgtgaggccaagctaatctcttaaagccgttctcagttcggattgtaggctgcaactcgcctacatgaagttggaatcgctagtaatcgcggatcagcatgccgcggtgaatacgttcccgggccttgtacacaccgcccgtcacaccatgagagtttgtaacacccaaagccggtggggtaaccttcgggagccagccgtctaaggtgggacagatgattagggtgaagtcgtaacaaggtagccgtaggagaacctgcggctggatcacctcctttctaaggaa

SEQ ID NO: 4911 - DNA, 1574 bp, Lactobacilus nuruki
  ref <308>: DATABASE ACCESSION NUMBER: NCBI ACCESSION: NZ_NIPR01000037.1
  ref <309>: DATABASE ENTRY DATE: 2019-04-01
  ref <313>: RELEVANT RESIDUES IN SEQ ID NO: (1)..(1574)
taatatgagagtttgatcctggctcaggacgaacgctggcggcatgcctaatacatgcaagtcgaacgaaccaaaccattgattggagcttgctccttgatttggaccttggtgagtggcggacgggtgagtaacacgtgggtaacctgcccaaaagtgggggataacatctggaaacaggtgctaataccgcataacaactactttcacatgatcgtagcttgaaagatggctctgctatcgcttttggatggacccgcggcgtattagctagttggtgaggtaacggctcaccaaggcaatgatacgtagccgacctgagagggtaatcggccacattgggactgagacacggcccaaactcctacgggaggcagcagtagggaatcttccacaatgggcgaaagcctgatggagcaatgccgcgtgagtgaagaaggttttcggatcgtaaaactctgttgttgaagaagaacatgcgtgagagtaactgttcacgtactgacggtattcaaccagaaagccacggctaactacgtgccagcagccgcggtaatacgtaggtggcaagcgttgtccggatttattgggcgtaaagagaatgtaggcggtttattaagtttgaagtgaaagccctcggctcaaccgaggaagtgcttcgaaaactggtaaacttgagtgcagaagaggaaagtggaactccatgtgtagcggtggaatgcgtagatatatggaagaacaccagtggcgaaggcggctttctggtctgtaactgacgctgagattcgaaagcatgggtagcaaacaggattagataccctggtagtccatgccgtaaacgatgagtgctaagtgttggagggtttccgcccttcagtgctgcagctaacgcattaagcactccgcctggggagtacgatcgcaagattgaaactcaaaggaattgacgggggcccgcacaagcggtggagcatgtggtttaattcgaagcaacgcgaagaaccttaccaggtcttgacataccatgaaaagcttagagataagtctttcccttcggggacatggatacaggtggtgcatggttgtcgtcagctcgtgtcgtgagatgttgggttaagtcccgcaacgagcgcaacccttattatcagttgccagcatttagttgggcactctggtgagactgccggtgacaaaccggaggaaggtggggacgacgtcaaatcatcatgccccttatgacctgggctacacacgtgctacaatggtcggtacaacgtgctgcgaactcgcgagggtaagcaaatcacttaaaaccgatctcagttcggattgtaggctgcaactcgcctacatgaagctggaatcgctagtaatcgcggatcagcatgccgcggtgaatacgttcccgggccttgtacacaccgcccgtcacaccatgagagtttgtaacacccaaagccggtggggtaacccttcggggagctagccgtctaaggtgggacaaatgattagggtgaagtcgtaacaaggtagccgtaggagaacctgcggctggatcacctcctttctaagga

SEQ ID NO: 4912 - DNA, 1098 bp, Lactococcus chungangensis
  ref <308>: DATABASE ACCESSION NUMBER: NCBI ACCESSION: NZ_FPKS01000041.1
  ref <309>: DATABASE ENTRY DATE: 2019-04-01
  ref <313>: RELEVANT RESIDUES IN SEQ ID NO: (1)..(1098)
gttgattagagtggaaaattaatcaagtgacggtatctaaccagaaagggacggctaactacgtgccagcagccgcggtaatacgtaggtcccgagcgttgtccggatttattgggcgtaaagcgagcgcaggtggtttaataagtctgatgtaaaaggcagtggctcaaccattgtgtgcattggaaactgttagacttgagtgcagtagaggagagtggaattccatgtgtagcggtgaaatgcgtagatatatggaggaacaccggtggcgaaagcggctctctggactgtcactgacactgaggctcgaaagcgtgggtagcaaacaggattagataccctggtagtccacgccgtaaacgatgagtgctagttgtttggggctatccagccctaagtgacgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccttattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagacagtgatgtcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaatacccaaagccggtgagctaaccttttaggaggcagccgtctaaggtaggatagatgattggggtgaagtcgtaacaaggtagccgtatcggaaggtgcggctggatcacctcctttctaaggaa

SEQ ID NO: 4913 - DNA, 1521 bp, Lactococcus fujiensis
  ref <308>: DATABASE ACCESSION NUMBER: NCBI ACCESSION: NZ_JXJU01000042.1
  ref <309>: DATABASE ENTRY DATE: 2019-04-01
  ref <313>: RELEVANT RESIDUES IN SEQ ID NO: (1)..(1521)
aatgagagtttgatcctggctcaggacgaacgctggcggcgtgcctaatacatgcaagtcgagcgatgataatttagcttgctaaatttgacgagcggcgaacgggtgagtaacgcgtggggaatctgccgaggagcgggggacaacatttggaaacgaatgctaataccgcataaaagcttgaaagacatctttcgagtttgaaaggaacaattgtttcactcctcgatgatcccgcgttgtattagctagttggtagggtaacggcctaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaagctctgttgttgttaaagaacgtctgtgagagtggaaagttcacagagtgacggtaaacaaccagaaagggacggctaactacgtgccagcagccgcggtaatacgtaggtcccgagcgttgtccggatttattgggcgtaaagcgagcgcaggtggtttcttaagtctggtgtaaaaggctactgctcaacagtagtgtgcattggaaactgggagacttgagtgcaggagaggagagtggaattccatgtgtagcggtgaaatgcgtagatatatggaggaacaccggaggcgaaagcggctctctggcctgtaactgacactgaggctcgaaagcgtggggagcaaacaggattagataccctggtagtccacgccgtaaacgatgagtgctagatgtgggaagctataagttttccgtatcgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatactgatgctatccttagagataaggagttccttcgggacatcggatacaggtggtgcatggttgtcgtcagctcgtgtcgtgagatgttgggttaagtcccgcaacgagcgcaacccctattactagttgccatcattaagttgggcactctagtgagactgccggtgataaaccggaggaaggtggggatgacgtcaaatcatcatgccccttatgacctgggctacacacgtgctacaatggatggtacaacgagtcgcgagacagtgatgtttagctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccatgggagttgggagtacccgaagtaggttgcctaaccgtaaggagggcgcttcctaaggtaagaccgatgactggggtgaagtcgtaacaaggtagccgtatcggaagg

SEQ ID NO: 4914 - DNA, 1554 bp, Lactococcus garvieae
  ref <308>: DATABASE ACCESSION NUMBER: NCBI ACCESSION: NZ_FOTJ01000028.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtcgagcgatgattaaagatagcttgctatttttatgaagagcggcgaacgggtgagtaacgcgtgggaaatctgccgagtagcgggggacaacgtttggaaacgaacgctaataccgcataacaatgagaatcgcatgattcttatttaaaagaagcaattgcttcactacttgatgatcccgcgttgtattagctagttggtagtgtaaaggactaccaaggcgatgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaaactctgttgttagagaagaacgttaagtagagtggaaaattacttaagtgacggtatctaaccagaaagggacggctaactacgtgccagcagccgcggtaatacgtaggtcccaagcgttgtccggatttattgggcgtaaagcgagcgcaggtggtttcttaagtctgatgtaaaaggcagtggctcaaccattgtgtgcattggaaactgggagacttgagtgcaggagaggagagtggaattccatgtgtagcggtgaaatgcgtagatatatggaggaacaccggaggcgaaagcggctctctggcctgtaactgacactgaggctcgaaagcgtggggagcaaacaggattagataccctggtagtccacgccgtaaacgatgagtgctagctgtagggagctataagttctctgtagcgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctatccttagagataaggagttccttcgggacacgggatacaggtggtgcatggttgtcgtcagctcgtgtcgtgagatgttgggttaagtcccgcaacgagcgcaacccttattactagttgccatcattaagttgggcactctagtgagactgccggtgataaaccggaggaaggtggggatgacgtcaaatcatcatgccccttatgacctgggctacacacgtgctacaatggatggtacaacgagtcgccaacccgcgagggtgcgctaatctcttaaaaccattctcagttcggattgcaggctgcaactcgcctgcatgaagtcggaatcgctagtaatcgcggatcagcacgccgcggtgaatacgttcccgggccttgtacacaccgcccgtcacaccacggaagttgggagtacccaaagtaggttgcctaaccgcaaggagggcgcttcctaaggtaagaccgatgactggggtgaagtcgtaacaaggtagccgtatcggaaggtgcggctggatcacctcctttctaaggaa

SEQ ID NO: 4915 - DNA, 1552 bp, Lactococcus lactis
  ref <308>: DATABASE ACCESSION NUMBER: NCBI ACCESSION: NZ_OLME01000004.1
  ref <309>: DATABASE ENTRY DATE: 2019-04-01
  ref <313>: RELEVANT RESIDUES IN SEQ ID NO: (1)..(1552)
tttgagagtttgatcctggctcaggacgaacgctggcggcgtgcctaatacatgcaagttgagcgctgaaggttggtacttgtaccgactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttggtagagaagaacgttggtgagagtggaaagctcatcaagtgacggtaactacccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctaacgagactgccggtgataaaccggaggaaggtggggatgacgtcaaatcatcatgccccttatgacctgggctacacacgtgctacaatggatggtacaacgagtcgcgagacagtgatgtttagctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccacgggagttgggagtacccgaagtaggttgcctaaccgcaaggagggcgcttcctaaggtaagaccgatgactggggtgaagtcgtaacaaggtagccgtatcggaaggtgcggctggatcacctcctttctaaggaa

SEQ ID NO: 4916 - DNA, 1554 bp, Lactococcus petauri
  ref <308>: DATABASE ACCESSION NUMBER: NCBI ACCESSION: NZ_QVHV01000007.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtcgagcgatgattaaagatagcttgctatttttatgaagagcggcgaacgggtgagtaacgcgtgggaaatctgccgagtagcgggggacaacgtttggaaacgaacgctaataccgcataacaatgagaatcgcatgattcttatttgaaagaagcaattgcttcactacttgatgatcccgcgttgtattagctagttggtagtgtaaaggactaccaaggcgatgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaaactctgttgttagagaagaacgttaagtagagtggaaaattacttaagtgacggtatctaaccagaaagggacggctaactacgtgccagcagccgcggtaatacgtaggtcccaagcgttgtccggatttattgggcgtaaagcgagcgcaggtggtttcttaagtctgatgtaaaaggcagtggctcaaccattgtgtgcattggaaactgggagacttgagtgcaggagaggagagtggaattccatgtgtagcggtgaaatgcgtagatatatggaggaacaccggaggcgaaagcggctctctggcctgtaactgacactgaggctcgaaagcgtggggagcaaacaggattagataccctggtagtccacgccgtaaacgatgagtgctagctgtagggagctataagttctctgtagcgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctatccttagagataaggagttccttcgggacacgggatacaggtggtgcatggttgtcgtcagctcgtgtcgtgagatgttgggttaagtcccgcaacgagcgcaacccttattactagttgccatcattaagttgggcactctagtgagactgccggtgataaaccggaggaaggtggggatgacgtcaaatcatcatgccccttatgacctgggctacacacgtgctacaatggatggtacaacgagtcgccaacccgcgagggtgcgctaatctcttaaaaccattctcagttcggattgcaggctgcaactcgcctgcatgaagtcggaatcgctagtaatcgcggatcagcacgccgcggtgaatacgttcccgggccttgtacacaccgcccgtcacaccacggaagttgggagtacccaaagtaggttgcctaaccgcaaggagggcgcttcctaaggtaagaccgatgactggggtgaagtcgtaacaaggtagccgtatcggaaggtgcggctggatcacctcctttctaaggaa

SEQ ID NO: 4917 - DNA, 1554 bp, Lactococcus piscium
  ref <308>: DATABASE ACCESSION NUMBER: NCBI ACCESSION: NZ_LT992557.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagttgaacgatgatttctggtacttgtatcagaatgaagagtagcgaacgggtgagtaacgcgtgggtaacctacctcttagcgggggacaactattggaaacgatagctaataccgcataacaatgcttaacacatgttgagtatttgaaagtaccaattggtacactaggagatggacccgcgttgtattagctagttggtagtgtaatggactaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacgttgtgtagagtggaaaattacacaagtgacggtatctaaccagaaagggacggctaactacgtgccagcagccgcggtaatacgtaggtcccgagcgttgtccggatttattgggcgtaaagcgagcgcaggtggtttaataagtctgatgtaaaaggcagtggctcaaccattgtgtgcattggaaactgttagacttgagtgcagtagaggagagtggaattccatgtgtagcggtgaaatgcgtagatatatggaggaacaccggtggcgaaagcggctctctggactgtaactgacactgaggctcgaaagcgtgggtagcaaacaggattagataccctggtagtccacgccgtaaacgatgagtgctagttgtttggggctatccagccctaagtgacgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccagtgctattcttagagataagaagttacttcggtacactggatacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagctagtgatagcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaatacccaaagccggtgagctaaccttttaggaggcagccgtctaaggtaggatagatgattggggtgaagtcgtaacaaggtagccgtatcggaaggtgcggctggatcacctcctttctaaggaa

SEQ ID NO: 4918 - DNA, 1554 bp, Lactococcus plantarum
  ref <308>: DATABASE ACCESSION NUMBER: NCBI ACCESSION: NZ_JXJX01000025.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagttgaacgctgaagactggtacttgtactagttggatgagtagcgaacgggtgagtaacgcgtgggtaacctacctcttagcgggggacaactattggaaacgatagctaataccgcataacaatatttaacacatgttaagtatttgaaagcaccaattggtgcactaagagatggacccgcgttgtattagctagttggtagtgtaatggactaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacgtcagtgagagtggaaagttcactgagtgacggtatctaaccagaaagggacggctaactacgtgccagcagccgcggtaatacgtaggtcccgagcgttgtccggatttattgggcgtaaagcgagcgcaggtggtttaataagtctgatgtaaaaggcagtggctcaaccattgtgtgcattggaaactgttagacttgagtgcagtagaggagagtggaattccatgtgtagcggtgaaatgcgtagatatatggaggaacaccggtggcgaaagcggctctctggactgtaactgacactgaggctcgaaagcgtgggtagcaaacaggattagataccctggtagtccacgccgtaaacgatgagtgctagttgtttggggctatccagccctaagtgacgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccagtgctattcttagagataagaagttacttcggtacactggatacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagctggtgacagcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaatacccaaagccggtgagctaacctttatggaggcagccgtctaaggtaggatagatgattggggtgaagtcgtaacaaggtagccgtatcggaaggtgcggctggatcacctcctttctaaggaa

SEQ ID NO: 4919 - DNA, 1562 bp, Lactococcus raffinolactis
  ref <308>: DATABASE ACCESSION NUMBER: NCBI ACCESSION: NZ_JXJY01000063.1
  ref <309>: DATABASE ENTRY DATE: 2019-04-01
  ref <313>: RELEVANT RESIDUES IN SEQ ID NO: (1)..(1562)
aatgagagtttgatcctggctcaggacgaacgctggcggcgtgcctaatacatgcaagttgaacgcttgattttcaccgaagcttgcttcaccgaaaatcaagagtagcgaacgggtgagtaacgcgtgggtaacctacctatcagcgggggataactattggaaacgatagctaataccgcataacaatgttggatgcatattcgacatttgaaagtaccaaatggtacactgagagatggacccgcgttgtattagctagttggtagtgtaatggactaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacgttgcatagagtggaaaattatgcaagtgacggtatctaaccagaaagggacggctaactacgtgccagcagccgcggtaatacgtaggtcccgagcgttgtccggatttattgggcgtaaagcgagcgcaggtggtttaataagtctgatgtaaaaggcagtggctcaaccattgtgtgcattggaaactgttagacttgagtgcagtagaggagagtggaattccatgtgtagcggtgaaatgcgtagatatatggaggaacaccggtggcgaaagcggctctctggactgtcactgacactgaggctcgaaagcgtgggtagcaaacaggattagataccctggtagtccacgccgtaaacgatgagtgctagttgtttggggctatccagccctaagtgacgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaaggcagtgatgtcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaatacccaaagccggtgagctaaccttttaggaggcagccgtctaaggtaggatagatgattggggtgaagtcgtaacaaggtagccgtatcggaaggtgcggctggatcacctcctttctaaggaa

SEQ ID NO: 4920 - DNA, 1562 bp, Lactococcus reticulitermitis
  ref <308>: DATABASE ACCESSION NUMBER: NCBI ACCESSION: NZ_BEDT01000006.1
  ref <309>: DATABASE ENTRY DATE: 2019-04-01
  ref <313>: RELEVANT RESIDUES IN SEQ ID NO: (1)..(1562)
aatgagagtttgatcctggctcaggacgaacgctggcggcgtgcctaatacatgcaagttgaacgcttgatttccaccgaagcttgcttcatcggaaatcaagagtagcgaacgggtgagtaacgcgtgggtaacctacctatcagcgggggataactattggaaacgatagctaataccgcataacaatgggaattgcataatttctatttgaaagtaacaattgttacactgagagatggacccgcgttgtattagctagttggtagtgtaatggactaccaaggcgatgatacatagccgacctgagagggtgatcggccacattgggactgagacacggcccaaactcctacgggaggcagcagtagggaatcttcggcaatggacggaagtctgaccgagcaacgccgcgtgagtgaagaaggttttcggatcgtaaaactctgttgttagagaagaacgttgcatagagtggaaagttatgcaagtgacggtatctaaccagaaagggacggctaactacgtgccagcagccgcggtaatacgtaggtcccgagcgttgtccggatttattgggcgtaaagcgagcgcaggtggtttaataagtctgatgtaaaaggcagtggctcaaccattgtgtgcattggaaactgttagacttgagtgcagtagaggagagtggaattccatgtgtagcggtgaaatgcgtagatatatggaggaacaccggtggcgaaagcggctctctggactgtcactgacactgaggctcgaaagcgtgggtagcaaacaggattagataccctggtagtccacgccgtaaacgatgagtgctagttgtttggggctatccagccctaagtgacgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacataccagtgctattcctagagataggaagttacttcggtacactggatacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggttggtacaacgagtcgcaagctggtgacagcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaatacccaaagccggtgagctaaccttttaggaggcagccgtctaaggtaggatagatgattggggtgaagtcgtaacaaggtagccgtatcggaaggtgcggctggatcacctcctttctaaggaa

SEQ ID NO: 4921 - DNA, 1552 bp, Lactococcus sp. 1JSPR-7
  ref <308>: DATABASE ACCESSION NUMBER: NCBI ACCESSION: NZ_CP032627.1
  ref <309>: DATABASE ENTRY DATE: 2019-04-01
  ref <313>: RELEVANT RESIDUES IN SEQ ID NO: (1)..(1552)
tttgagagtttgatcctggctcaggacgaacgctggcggcgtgcctaatacatgcaagttgagcgctgaaggaaggtacttgtaccgactggaagagcagcgaacgggtgagtaacgcgtggggaatctgcctttgagcgggggacaacatttggaaacgaatgctaataccgcataacaactttaaacacaagttaaaagtttgaaagatgcaaaagcatcactcagagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacgtgtgtgggagtggaaaatccatgcagtgacggtatctaaccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtaggaagctataagttttctgtatcgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatccttagagataaggagttacttcggtacatcggtgacaggtggtgcatggttgtcgtcagctcgtgtcgtgagatgttgggttaagtcccgcaacgagcgcaacccctattactagttgccatcattaagttgggcactctagtgagactgccggtgataaaccggaggaaggtggggatgacgtcaaatcatcatgccccttatgacctgggctacacacgtgctacaatggatggtacaacgagtcgcgagacagtgatgtttagctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccacgggagttgggagtacccgaagtaggttgcctaaccgcaaggagggcgcttcctaaggtaagaccgatgactggggtgaagtcgtaacaaggtagccgtatcggaaggtgcggctggatcacctcctttctaaggaa

SEQ ID NO: 4922 - DNA, 1554 bp, Lactococcus sp. DD01; identical to SEQ ID NO: 4916
  ref <308>: DATABASE ACCESSION NUMBER: NCBI ACCESSION: NZ_KQ968948.1
  ref <309>: DATABASE ENTRY DATE: 2019-04-01
  ref <313>: RELEVANT RESIDUES IN SEQ ID NO: (1)..(1554)

SEQ ID NO: 4923 - DNA, 1552 bp, Lactococcus sp. S-13
  ref <308>: DATABASE ACCESSION NUMBER: NCBI ACCESSION: NZ_SDAK01000001.1
  ref <309>: DATABASE ENTRY DATE: 2019-04-01
  ref <313>: RELEVANT RESIDUES IN SEQ ID NO: (1)..(1552)
tttgagagtttgatcctggctcaggacgaacgctggcggcgtgcctaatacatgcaagttgagcgatgcggtttggtgcttgcactaaaccaaagagcagcgaacgggtgagtaacgcgtgggaaatctgcctttgagcgggggacaacatttggaaacgaatgctaataccgcataacagctagggacacatgttctaagcttgaaagaaacaattgtttcactcaaagatgatcccgcgttgtattagctagttggtgaggtaaaggctcaccaaggcgatgatacatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgtgagagaagaacgacgaggagagtggaaagctcctcgtgtgacggtatctcaccagaaagggacggctaactacgtgccagcagccgcggtaatacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacaggattagataccctggtagtccacgccgtaaacgatgagtgctagatgtagggagctataagttctctgtatcgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatactcgtgctattcctagagataggaagttccttcgggacacgggatacaggtggtgcatggttgtcgtcagctcgtgtcgtgagatgttgggttaagtcccgcaacgagcgcaacccctattgttagttgccatcattaagttgggcactctaacgagactgccggtgataaaccggaggaaggtggggatgacgtcaaatcatcatgccccttatgacctgggctacacacgtgctacaatggatggtacaacgagtcgcgagacagtgatgtttagctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccacgggagttgggagtacccgaagttggttgcctaaccgcaaggagggcgctacctaaggtaagaccgatgactggggtgaagtcgtaacaaggtagccgtatcggaaggtgcggctggatcacctcctttctaaggaa

SEQ ID NO: 4924 - DNA, 1561 bp, Lactococcus termiticola
  ref <308>: DATABASE ACCESSION NUMBER: NCBI ACCESSION: NZ_BFFO01000018.1
  ref <309>: DATABASE ENTRY DATE: 2019-04-01
  ref <313>: RELEVANT RESIDUES IN SEQ ID NO: (1)..(1561)
ttaacgagagtttgatcctggctcaggacgaacgctggcggcgtgcctaatacatgcaagtggaacgcttcaaactacaccgtgcttgcacatcgtagtttgaagagtcgcgaacgggtgagtaacgcgtgggaaatctgcctcttagcgggggacaacctttggaaacgaaggctaataccgcataacaatgaaatactcatgtattttatttgaaaggcgcttcggcgtcactaagagatgatcccgcgttggattagctagttggtagggtaaaggcctaccaaggcaatgatccatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgtaagagaagaacgtgtgtgagaggaaatgttcacacagtgacggtatcttaccagaaagggacggctaactacgtgccagcagccgcggtaatacgtaggtcccgagcgttgtccggatttattgggcgtaaagcgagcgcaggtggtttcttaagtctgatgttaaaggcagtggctcaaccattgtacgcattggaaactgggagacttgagtgtaggagaggagagtggaattccatgtgtagcggtgaaatgcgtagatatatggaggaacaccggaggcgaaagcggctctctggcctattactgacactgaggctcgaaagcgtggggagcaaacaggattagataccctggtagtccacgccgtaaacgatgagtgctagctgtttggagctataagttctaagtagcgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatacgggtgctactcctagagataggaggttccttcgggacacccgatacaggtggtgcatggttgtcgtcagctcgtgtcgtgagatgttgggttaagtcccgcaacgagcgcaacccctattgttagttgccatcattaagttgggcactctagcgagactgccggtgacaaaccggaggaaggtggggatgacgtcaaatcatcatgccccttatgacctgggctacacacgtgctacaatggatggtacaacgagtcgctacacagtgatgtgatgctaatctcttaaaaccattctcagttcggattgtaggctgcaactcgcctacatgaagtcggaatcgctagtaatcgcggatcagcacgccgcggtgaatacgttcccgggccttgtacacaccgcccgtcacaccacgggagttgggggtgcccgaagtcgattgcctaaccttttggagggcgtcgcctaaggcaaaaccgatgactggggtgaagtcgtaacaaggtagccgtatcggaaggtgcggctggatcacctcctttctaaggaa

SEQ ID NO: 4925 - DNA, 1441 bp, Lactonifactor longoviformis
  ref <308>: DATABASE ACCESSION NUMBER: NCBI ACCESSION: NZ_FQVI01000073.1
  ref <309>: DATABASE ENTRY DATE: 2019-04-01
  ref <313>: RELEVANT RESIDUES IN SEQ ID NO: (1)..(1441)
tatatgactgagtggcggacgggtgagtaacgcgtggataacctgcctcatacagggggataacagttagaaatgactgctaataccgcataagcgcacagtgctgcatggcacagtgtgaaaagctccggcggtatgagatggatccgcgtttgattagctagttggtggggtaaaggcctaccaaggcgacgatcaatagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaattacgtgccagcagccgcggtaatacgtaaggggcaagcgttatccggatttactgggtgtaaagggagcgtagacggcagtgcaagtctgatgtgaaagcccggggctcaaccccgggactgcattggaaactgtgcagctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatactaggtgtcgggcgccaaaggcgttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatctgcctgaccggtccgtaacaggacccttccttcgggacaggcaagacaggtggtgcatggttgtcgtcagctcgtgtcgtgagatgttgggttaagtcccgcaacgagcgcaacccttatccttagtagccagcaggtagagctgggcactctagggagactgccagggacaacctggaggaaggtggggatgacgtcaaatcatcatgccccttatgatttgggctacacacgtgctacaatggcgtaaacaaagggaagcgaaggggtgacctgaagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggatatgcccgaagccggtgaccgaacccgaaagggaaggagccgtcgaaggtggagccgataactggggtgaagtcgtaacaaggtagccgtatcggaaggtgcggctggatcacctcctttctaaggaa

SEQ ID NO: 4926 - DNA, 1564 bp, Lacunisphaera sp. TWA-58
  ref <308>: DATABASE ACCESSION NUMBER: NCBI ACCESSION: NZ_SDHX01000002.1
  ref <309>: DATABASE ENTRY DATE: 2019-04-01
  ref <313>: RELEVANT RESIDUES IN SEQ ID NO: (1)..(1564)
ttttcggagagtttgatcctggctcagaatgaacgctggcggcgtggttaagacatgcaagtcgaacgggttttcaggtgtagcaatacacatgaaagccagtggcgaacgggtgcgtaacacgtgaacaatctaccatttagtgtggaatagctcgccgaaaggcgaattaataccgcatgtggttctcttccgcatggaagggatactaaagtcagggaccgcaaggcctgacgctaattgaggagttcgcggcctatcagctagttggcgaggtaacggctcaccaaggctaagacgggtagctgatctgagaggatgatcagccacactggaactgagacacggtccagacacctacgggtggcagcagtttcgaatcattcacaatgggcgaaagcctgatggtgcgacgccgcgtgagggatgaaggtcttcggattgtaaacctctgtcactggggagaaaacgctttgagttaatagttcaaagcctgatttaacccggagaggaagcagtggctaactctgtgccagcagccgcggtaatacagagactgcaagcgttattcggattcactgggcgtaaagggtgcgcaggcggccgtgtgtgttagatgtgaaatcccggggctcaaccccggaactgcgtctaaaactacatggctagagtattggagagggtaacggaattcacggtgtagcagtgaaatgcgtagatatcgtgaggaacaccagaggcgaaggcggttacctggacaattactgacgctcaggcacgaaagcgtggggagccaaagggattagatacccctgtagtccacgccctaaacggtgcacactaggtcttggcggattcgaccccaccagggcccaagctaacgcgttaagtgtgccgcctgaggactacggtcgcaagactaaaactcaaaggaattgacgggggcccgcacaagcggtggagcatgtggctcaattcgatgcaacgcgaagaaccttaccaggccttgacatgcactagacagactctgaaaggagtcctcccttcggggctggtgcacaggtgctgcatggctgtcgtcagctcgtgtcgtgagatgttgcgttaagtcgcgcaacgagcgcaacccctgtccttagttgccatcaggtaaagctgggcactctagggagacaaaccctctctgagggtgggaaggtggggatgacgtcaagtcaggatggcccttacggcctgggctgcacacgtgctacaatgctcggtacagagggacgcaataccgcgaggtggagcaaatcccaaaaaccgagcccagttcagattgcagtctgcaactcgactgcatgaagccggaatcgctagtaatggcgtatcagctacgacgccgtgaatacgttcccgggccttgtacacaccgcccgtcacgtcatgaaagccggttttgcccgaagtgcgtttgccaaccagcaatggaggcggcgccctaaggtgaggctggtgattgggacgaagtcgtaacaaggtagccgtaggggaacctgcggctggatcacctcctttttaa

SEQ ID NO: 4927 - DNA, 1519 bp, Larkinella arboricola
  ref <308>: DATABASE ACCESSION NUMBER: NCBI ACCESSION: NZ_QLMC01000033.1
  ref <309>: DATABASE ENTRY DATE: 2019-04-01
  ref <313>: RELEVANT RESIDUES IN SEQ ID NO: (1)..(1519)
tttacaatggagagtttgatcctggctcaggatgaacgctagcggcaggcctaatacatgcaagtcgaacggatgaccttcgggtcattagtggcgcacgggtgcgtaacgcgtaagcaacctacctgctactgggggatagccctgggaaaccgggagtaaacccgcatggtatcattaacctacctgggttgatgattaaagatttatcggtagcagatgggcttgcgttggattagctagatggcggggtaatggcccaccatggcgatgatccataggggctctgagaggagcggcccccacactggcactgagacacgggccagactcctacgggaggcagcagtagggaatattgggcaatggacgcaagtctgacccagccatgccgcgtgcaggatgaaggcgctcagcgttgtaaactgcttttgatagggaagaacggccttcttgcgagaaggtgtgacggtacctacagaataagcaccggctaactccgtgccagcagccgcggtaatacggagggtgcaagcgttgtccggatttattgggtttaaagggtgcgtaggtggctttttaagtctgacctgaaagtgggccgcttaacggcacagggtggttggatactgaagagcttgaagagggtggaggccgccggaacggatcgtgtagcggtgaaatgcatagagatgatccagaaccccgattgcgtaggcaggcggctacgccccacttgacactgaggcacgagagcatggggagcaaacaggattagataccctggtagtccatgccgtaaacgatgataactcgctgttggccctttggggtcagtggcttagcgaaagcggtaagttatccacctggggagtacgccggcaacggtgaaactcaaaggaattgacgggggtccgcacaagcggtggagcatgtggtttaattcgatgatacgcgaggaaccttacctgggctagaatgtgcgtgaagctatcagagatggtagcgcctagcaataggcacaaaacaaggtgctgcatggctgtcgtcagctcgtgccgtgaggtgttgggttaagtcccgcaacgagcgcaacccctgattgtagttgccagcacgtaatggtggggactctacagtgactgccttcgcaagaagagaggaaggaggggacgacgtcaagtcatcatggcccttacgcccagggcgacacacgtgctacaatggtgcccacagcgggtagcgaggtggtaacactgagccaatcttgaaaaaggcatcacagttcggattggggtctgcaacccgaccccatgaagctggaatcgctagtaatcgcgcatcagccatggcgcggtgaatacgttcccggaccttgtacacaccgcccgtcaagccatggaagtcggggggacctgaagctcggcgtcatacaccgggtcagggtaaacccggtaactggggctaagtcgtaacaaggtagccgtaccggaaggtgcggctggaacacctcctttct

SEQ ID NO: 4928 - DNA, 1516 bp, Larkinella knui
  ref <308>: DATABASE ACCESSION NUMBER: NCBI ACCESSION: NZ_RQJP01000011.1
  ref <309>: DATABASE ENTRY DATE: 2019-04-01
  ref <313>: RELEVANT RESIDUES IN SEQ ID NO: (1)..(1516)
tttacaatggagagtttgatcctggctcaggatgaacgctagcggcaggcctaatacatgcaagtcgaacggataccttcgggtattagtggcgtacgggtgcgtaacgcgtaaacaatctaccttctactgggggatagccctgggaaaccgggagtaagcccgcatggcaccaattcctttcatgaggagctggttaaagattgatcggtaggagatgagtttgcgtctgattagttagttggcggggtaacggcccaccaagacgatgatcagtaggggctctgagaggagcggcccccacactggcactgagacacgggccagactcctacgggaggcagcagtagggaatattgggcaatggacgaaagtctgacccagccatgccgcgtgcaggaagacggcgctcagcgttgtaaactgcttttatctgggaagaatagacactctgcggagtgttgtgacggtaccagaggaataagcaccggctaactccgtgccagcagccgcggtaatacggagggtgcaagcgttgtccggatttattgggtttaaagggtgcgtaggtggcctggtaagtctgacctgaaagtgggccgcttaacggcacagggtggttggatactgtcaggcttgaagagggtggaggccgccggaacggatcgtgtagcggtgaaatgcatagagatgatccagaaccccgattgcgtaggcaggcggctacgccccacttgacactgaggcacgagagcatggggagcaaacaggattagataccctggtagtccatgccgtaaacgatgataactcgctgctggccctacgggtcagtggcttagcgaaagcggtaagttatccacctggggagtacgccggcaacggtgaaactcaaaggaattgacgggggtccgcacaagcggtggagcatgtggtttaattcgatgatacgcgaggaaccttacctgggctagaatgtgcgtgaagatatcagagatggtatcgtgtagcaatacacacaaaacaaggtgctgcatggctgtcgtcagctcgtgccgtgaggtgttgggttaagtcccgcaacgagcgcaacccctgttcctagttgccatcaggtaatgctggggactctaggaagactgccttcgcaagaagagaggaagggggggacgacgtcaagtcatcatggcccttacgtccagggcgacacacgtgctacaatggtgccgacagcgggtagcgaggtggcaacactgagccaatcttgaaaagggcatcacagttcggattggggtctgcaacccgaccccatgaagctggaatcgctagtaatcgcgcatcagccatggcgcggtgaatacgttcccggaccttgtacacaccgcccgtcaagccatgggagtcggggggacctgaagctccgtgttaacatcggggtcagggtaaacccggtgactggggctaagtcgtaacaaggtagccgtaccggaaggtgcggctggaacacctcctttct

SEQ ID NO: 4929 - DNA, 1426 bp, Larkinella rosea
  ref <308>: DATABASE ACCESSION NUMBER: NCBI ACCESSION: NZ_RQJO01000012.1
  ref <309>: DATABASE ENTRY DATE: 2019-04-01
  ref <313>: RELEVANT RESIDUES IN SEQ ID NO: (1)..(1426)
tttacaatggagagtttgatcctggctcaggatgaacgctagcggcaggcctaatacatgcaagtcgaacggatagcttcggctattagtggcgtacgggtgcgtaacgcgtaaacaatctaccttctactgggggatagccctgggaaaccgggagtaagcccgcatggtaccattggttttcatgggctgatggttaaagatttatcggtaggagatgagtttgcgtctgattagctagttgggggggtaacggcccaccaaggcgatgatcagtaggggctctgagaggagcggcccccacactggcactgagacacgggccagactcctacgggaggcagcagtagggaatattgggcaatgggcggaagcctgacccagccatgccgcgtgcaggaagaaggcgctcagcgttgtaaactgcttttatctgggaagaaaagccgttctgcggaatggtgtgacggtaccagaggaataagcaccggctaactccgtgccagcagccgcggtaatacggagggtgcaagcgttgtccggatttattgggtttaaagggtgcgtaggtggttttgtaagtcagacctgaaagtgggccgcttaacggcacagggtggtttgatactgcagaacttgaagagggtggaggccgccggaacggatcgtgtagcggtgaaatgcatagagatgatccagaaccccgattgcgaaggcaggcggctacgccccacttgacactgaggcacgagagcatggggagcaaacaggattagataccctggtagtccatgccgtaaacgatgataactcgctgctggccctacgggtcagtggcttagcgaaagcggtaagttatccacctggggagtacgccggcaacggtgaaactcaaaggaattgacgggggtccgcacaagcggtggagcatgtggtttaattcgatgatacgcgaggaaccttacctgggctagaatgtgcgtgaagttatcagagatggtaacgtgtagcaatacacacaaaacaaggtgctgcatggctgtcgtcagctcgtgccgtgaggtgttgggttaagtcccgcaacgagcgcaacccctgttcttagttgccatcaggtaatgctggggactctaagaagactgccttcgcaagaagagaggaaggaggggacgacgtcaagtcatcatggcccttacgcccagggcgacacacgtgctacaatggtgccgacagcgggtagcgaggtggtaacactgagccaatcttgaaaagggcatcacagttcggattggggtctgcaacccgaccccatgaagctggaatcgctagtaatcgcgcatcagccatggcgcggtgaatacgttcccggaccttgtacacaccgcccgtcaagccatgggagtcggggggacctgaagctccgtgt

SEQ ID NO: 4930 - DNA, 1521 bp, Larkinella soli
  ref <308>: DATABASE ACCESSION NUMBER: NCBI ACCESSION: NZ_ML112623.1
  ref <309>: DATABASE ENTRY DATE: 2019-04-01
  ref <313>: RELEVANT RESIDUES IN SEQ ID NO: (1)..(1521)
tttacaatggagagtttgatcctggctcaggatgaacgctagcggcaggcctaatacatgcaagtcgaacggatgatcttcgggtcattagtggcgcacgggtgcgtaacgcgtaagcaacctaccttctactgggggatagccctgggaaaccgggagtaagcccgcatgatgcaggggtaccgcctggtactatttgctaaagattcatcggtagaagatgggcttgcgtccgattagctagttggcggggtaagggcccaccaaggcgatgatcggtcggggctctgagaggagcggcccccacactggcactgagacacgggccagactcctacgggaggcagcagtagggaatattgggcaatggcggaaacgctgacccagccatgccgcgtggaggaagacggcgctcagcgttgtaaactccttttatcggtgaagaacggcccgcttgcgagcgggtgtgacggtaaccgaggaatcagcaccggctaactccgtgccagcagccgcggtaatacggagggtgcaagcgttgtccggatttattgggtttaaagggtgcgtaggtgggtgcttaagtccgacctgaaagtgggccgctcaacggcacagggtggttggatactgggcgtcttgaagagggtggaggccgccggaacggatcgtgtagcggtgaaatgcatagagatgatccagaaccccgattgcgaaggcaggcggctacgccccacttgacactgaggcacgagagcatggggagcaaacaggattagataccctggtagtccatgccgtaaacgatgataactcgctgcgggccccatgggggtccgtggcttagcgaaagcggtaagttatccacctggggagtacgccggcaacggtgaaactcaaaggaattgacgggggtccgcacaagcggtggagcatgtggtttaattcgatgatacgcgaggaaccttacctgggctagaatgcgcgtgaagggctcagagatgggtccgccccgcaaggggcacaaagcaaggtgctgcatggctgtcgtcagctcgtgccgtgaggtgttgggttaagtcccgcaacgagcgcaacccctgactgtagttgccagcacgtgatggtggggactctacagtgactgcctgcgcaagcagagaggaagggggggacgacgtcaagtcatcatggcccttacgtccagggcgacacacgtgctacaatggtgccgacagcgggtagcgaggtggtaacactgagccaatcttgaaaagggcatcacagttcggattggggtctgcaacccgaccccatgaagctggaatcgctagtaatcgcgcatcagccatggcgcggtgaatacgttcccggaccttgtacacaccgcccgtcaagccatgggagtcggggggacctgaagctccgtgtaagaagcggggtcagggtaaacccggtgactggggctaagtcgtaacaaggtagccgtaccggaaggtgcggctggaacacctcctttct

SEQ ID NO: 4931 - DNA, 1510 bp, Larkinella sp. ZZJ9
  ref <308>: DATABASE ACCESSION NUMBER: NCBI ACCESSION: NZ_QOWE01000054.1
  ref <309>: DATABASE ENTRY DATE: 2019-04-01
  ref <313>: RELEVANT RESIDUES IN SEQ ID NO: (1)..(1510)
agagagtttgatcctggctcaggatgaacgctagcggcaggcctaatacatgcaagtcgaacggatgtccttcggggcattagtggcgtacgggtgcgtaacgcgtaaacaatctacctcatactgggggatagccctgggaaaccgggagtaagcccgcatggtaccacgagatttcatggttttgtggttaaagatttatcggtatgagatgagtttgcgtctgattagctagttggcggggtaacggcccaccaaggcgatgatcagtaggggctctgagaggagtggcccccacactggcactgagacacgggccagactcctacgggaggcagcagtagggaatattgggcaatggacggaagtctgacccagccatgccgcgtgcaggaagacggcgctcagcgttgtaaactgcttttatctgggaagaaaagaagccctgcggggttttgtgacggtaccagaggaataagcaccggctaactccgtgccagcagccgcggtaatacggagggtgcaagcgttgtccggatttattgggtttaaagggtgcgtaggtggttttgtaagtcagacctgaaagtgggccgcttaacggcacagggtggtttgatactgcagaacttgaagagggtggaggccgccggaacggatcgtgtagcggtgaaatgcatagagatgatccagaaccccgattgcgaaggcaggcggctacgccccacttgacactgaggcacgagagcatggggagcaaacaggattagataccctggtagtccatgccgtaaacgatgataactcgctgctggccctacgggtcagtggcttagcgaaagcggtaagttatccacctggggagtacgccggcaacggtgaaactcaaaggaattgacgggggtccgcacaagcggtggagcatgtggtttaattcgatgatacgcgaggaaccttacctgggctagaatgtgcgtgaagatatcagagatggtatcgtgtagcaatacacacaaaacaaggtgctgcatggctgtcgtcagctcgtgccgtgaggtgttgggttaagtcccgcaacgagcgcaacccctgttcttagttgccagcatgtaatgatggggactctaagaagactgccttcgcaagaagagaggaagggggggacgacgtcaagtcatcatggcccttacgtccagggcgacacacgtgctacaatggtgccgacagcgggtagcgaggtggcaacactgagccaatcttgaaaagggcatcacagttcggattggggtctgcaacccgaccccatgaagctggaatcgctagtaatcgcgcatcagccatggcgcggtgaatacgttcccggaccttgtacacaccgcccgtcaagccatgggagtcggggggacctgaagctccgtgttaacatcggggtcagggtaaacccggtgactggggctaagtcgtaacaaggtagccgtaccggaaggtgcggctggaacacctcctttct

SEQ ID NO: 4932 - DNA, 1537 bp, Lautropia mirabilis
  ref <308>: DATABASE ACCESSION NUMBER: NCBI ACCESSION: NZ_LR134378.1
  ref <309>: DATABASE ENTRY DATE: 2019-04-01
  ref <313>: RELEVANT RESIDUES IN SEQ ID NO: (1)..(1537)
agattgaactgaagagtttgatcctggctcagattgaacgctggcggcatgctttacacatgcaagtcgaacggcagcgcgggcttcggcctggcggcgagtggcgaacgggtgagtaatacatcggaacgtgcccagtagtgggggatagctcggcgaaagccggattaataccgcatacgacctgagggtgaaagcgggggatcttcggacctcgcgctattggagcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgatgaaggccttcgggttgtaaagcacttttggcgggaacgaaaaggactgtgccaataccacggttcgatgacggtacccgcagaataagcaccggctaactacgtgccagcagccgcggtaatacgtagggtgcaagcgttaatcggaattactgggcgtaaagagtgcgcaggcggttttgcaagaccgatgtgaaatccccgggcttaacctgggaactgcattggtgactgcaaggctagagtgtgtcagagggaggtggaattccgcatgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtctactagttgtcggggattaatttccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacgcttgacatgtccggaaccctgaagagatttgggggtgctcgaaagagagccggaacacaggtgctgcatggctgtcgtcagctcgtgtcgtgagatgttgggttaagtcccgcaacgagcgcaacccttatcattagttgctacgcaagggcactctaatgagactgccggtgacaaaccggaggaaggtggggatgacgtcaagtcctcatggcccttatgtgtagggcttcacacgtcatacaatggtcggtacagagggttgcgaagccgcgaggtggagccaatcccaaaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtgggttttaccagaagtaggtagcttaaccgcaaggagggcgcttaccacggtagggctcatgactggggtgaagtcgtaacaaggtagccgtaccggaaggtgcggctggatcacctcctttc

SEQ ID NO: 4933 - DNA, 1540 bp, Lautropia sp. KCOM 2505
  ref <308>: DATABASE ACCESSION NUMBER: NCBI ACCESSION: NZ_RRUE01000002.1
  ref <309>: DATABASE ENTRY DATE: 2019-04-01
  ref <313>: RELEVANT RESIDUES IN SEQ ID NO: (1)..(1540)
agattgaactgaagagtttgatcctggctcagattgaacgctggcggcatgctttacacatgcaagtcgaacggcagcgcgggcttcggcctggcggcgagtggcgaacgggtgagtaatacatcggaacgtgcccagtagtgggggatagctcggcgaaagccggattaataccgcatacgacctgagggtgaaagcgggggactttagggcctcgcgctattggagcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgatgaaggccttcgggttgtaaagcacttttggcgggaacgaaaaggactgtgccaataccacggttcgatgacggtacccgcagaataagcaccggctaactacgtgccagcagccgcggtaatacgtagggtgcgagcgttaatcggaattactgggcgtaaagagtgcgcaggcggttttgcaagaccgatgtgaaatccccgggcttaacctgggaactgcattggtgactgcaaggctagagtgtgtcagagggaggtggaactccgcatgtagcagtgaaatgcgtagatatgcggaagaacaccgatggcgaaggcagcctcctgggataacactgacgctcatgcacgaaagcgtggggagcaaacaggattagataccctggtagtccacgccctaaacgatgtctactagttgtcggggattaatttccttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacgcttgacatgtccggaaccttggagagattcgagggtgcccgaaagggaaccggaacacaggtgctgcatggctgtcgtcagctcgtgtcgtgagatgttgggttaagtcccgcaacgagcgcaacccttatcattagttgctacgcaagggcactctaatgagactgccggtgacaaaccggaggaaggtggggatgacgtcaagtcctcatggcccttatgtgtagggcttcacacgtcatacaatggtcggtacagagggttgccaagccgcgaggtggagccaatcccacaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtgggttttaccagaagtaggtagcttaaccgcaaggggggcgcttaccacggtagggctcatgactggggtgaagtcgtaacaaggtagccgtaccggaaggtgcggctggatcacctcctttcaag

SEQ ID NO: 4934 - DNA, 1538 bp, Lawsonibacter asaccharolyticus
  ref <308>: DATABASE ACCESSION NUMBER: NCBI ACCESSION: NZ_BFBT01000001.1
  ref <309>: DATABASE ENTRY DATE: 2019-04-01
  ref <313>: RELEVANT RESIDUES IN SEQ ID NO: (1)..(1538)
tttattgagagtttgatcctggctcaggatgaacgctggcggcgtgcttaacacatgcaagtcgaacggagtgccttagaaagaggattcgtccaattgataaggttacttagtggcggacgggtgagtaacgcgtgaggaacctgccttggagtggggaataacagaccgaaaggcctgctaataccgcatgatgcagttggaccgcatggtcctgactgccaaagatttatcgctctgagatggcctcgcgtctgattagcttgttggcggggtaatggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttctcagggacgaacaaatgacggtacctgaggaataagccacggctaactacgtgccagcagccgcggtaatacgtaggtggcaagcgttatccggatttactgggtgtaaagggcgtgtaggcgggaaggcaagtcagatgtgaaaactatgggctcaacccatagcctgcatttgaaactgtttttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgctgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcctactaacgaagcagagatgcattaggtgcccttcggggaaagtagagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggcggggacgacgtcaaatcatcatgccccttatgtcctgggctacacacgtactacaatggtggtaaacagagggaagcaagaccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagtctaaccgcaagggggacgcggccgaaggtgggttcgataattggggtgaagtcgtaacaaggtagccgtatcggaaggtgcggctggatcacctcctttctaagga

SEQ ID NO: 4935 - DNA, 1507 bp, Leadbetterella byssophila
  ref <308>: DATABASE ACCESSION NUMBER: NCBI ACCESSION: NC_014655.1
  ref <309>: DATABASE ENTRY DATE: 2019-04-01
  ref <313>: RELEVANT RESIDUES IN SEQ ID NO: (1)..(1507)
tttacaatggagagtttgatcctggctcaggatgaacgctagcggcaggcttaatacatgcaagtcgagggggcagcaatgtcaccggcgaacgggtgcgtaacgcgtatgcaacctacccatatcagggggatagccctaggaaactgggattaataccgcataacatagagaacggcatcgttttttattaaaagatttatcggatatggatgggcatgcgtaggattagctagttggtagggtaacggcttaccaaggctatgatccttaggggctctgagaggagtatcccccacactggcactgagatacgggccagactcctacgggaggcagcagtagggaatattgggcaatggaggcaactctgacccagccatgccgcgtgcaggaagaaggtcctctggattgtaaactgcttttgaatgggaagaaacgtagtcttgcgaggctatttgacggtactattagaataagcaccggctaactccgtgccagcagccgcggtaatacggagggtgcaagcgttatccggatttattgggtttaaagggtgcgtaggcggctttataagtcgatggttaaaggcagcagcttaactgtatgcatgccctcgatactgtagagcttgagtgatttggaggtggctagaattccctgtgtagcggtgaaatgcatagatacggggaggaataccgattgcgaaggcatgtcactacgaattaactgacgctgaggcacgaaagcgtggggatcaaacaggattagataccctggtagtccacgccgtaaacgatgattactagttgttggccgatgggtcagtgaccaagggaaaccgataagtaatccacctggggagtacgccggcaacggtgaaactcaaaggaattgacgggggtccgcacaagcggtggagcatgtggtttaattcgatgatacgcgaggaaccttacctaggctagaatgtgagcgaataattcagagatggattagtcagcaatgacgcgaaacaaggtgctgcatggccgtcgtcagttcgtgccgtgaggtgttgggttaagtcccgcaacgaacgcaacccctatgatctgttgccatcattaagttggggactcagatcagactgcctacgcaagtagagaggaaggaggggacgacgtcaggtcatcatggcccttacgcctagggcgacacacgtgctacaatggcatgaacagagtgcagcgagcttgtaagagtaagcgaatcacaaaaatcatgtcacagttcggattggggtctgcaactcgaccctatgaagctggaatcgctagtaatcgcatatcagccatgatgcggtgaatacgttcccggaccttgtacacaccgcccgtcaagccatgggagttgggtagacctgaagcggaaggtaacagacttcgttagggtagaaccagtgactggggctaagtcgtaacaaggtagccgtaccggaaggtgtggctggaacacctcctttata

SEQ ID NO: 4936 - DNA, 1550 bp, Leclercia adecarboxylata
  ref <308>: DATABASE ACCESSION NUMBER: NCBI ACCESSION: NZ_UASR01000074.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4937 - DNA, 1550 bp, Leclercia sp. LSNIH1
  ref <308>: DATABASE ACCESSION NUMBER: NCBI ACCESSION: NZ_CP026167.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttgccagagatggcttggtgccttcgggaactctgagacaggtgctgcatggctgtcgtcagctcgtgttgtgaaatgttgggttaagtcccgcaacgagcgcaacccttatcctttgttgccagcggctaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4938 - DNA, 1550 bp, Leclercia sp. LSNIH2; identical to SEQ ID NO: 4937
  ref <308>: DATABASE ACCESSION NUMBER: NCBI ACCESSION: NZ_PQKC01000058.1
  ref <309>: DATABASE ENTRY DATE: 2019-04-01
  ref <313>: RELEVANT RESIDUES IN SEQ ID NO: (1)..(1550)

SEQ ID NO: 4939 - DNA, 1550 bp, Leclercia sp. LSNIH3
  ref <308>: DATABASE ACCESSION NUMBER: NCBI ACCESSION: NZ_CP026387.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4940 - DNA, 1550 bp, Leclercia sp. LSNIH4; identical to SEQ ID NO: 4936
  ref <308>: DATABASE ACCESSION NUMBER: NCBI ACCESSION: NZ_PQKE01000055.1
  ref <309>: DATABASE ENTRY DATE: 2019-04-01
  ref <313>: RELEVANT RESIDUES IN SEQ ID NO: (1)..(1550)

SEQ ID NO: 4941 - DNA, 1550 bp, Leclercia sp. LSNIH5; identical to SEQ ID NO: 4937
  ref <308>: DATABASE ACCESSION NUMBER: NCBI ACCESSION: NZ_PQKB01000052.1
  ref <309>: DATABASE ENTRY DATE: 2019-04-01
  ref <313>: RELEVANT RESIDUES IN SEQ ID NO: (1)..(1550)

SEQ ID NO: 4942 - DNA, 1550 bp, Leclercia sp. LSNIH6
  ref <308>: DATABASE ACCESSION NUMBER: NCBI ACCESSION: NZ_PQKA01000033.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataatgtcgcaagaccaaagagggggaccttcgggcctcttgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgcggttaataaccgcagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttgccagagatggcttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 4943 - DNA, 1550 bp, Leclercia sp. LSNIH7; identical to SEQ ID NO: 4942
  ref <308>: DATABASE ACCESSION NUMBER: NCBI ACCESSION: NZ_PQKD01000033.1
  ref <309>: DATABASE ENTRY DATE: 2019-04-01
  ref <313>: RELEVANT RESIDUES IN SEQ ID NO: (1)..(1550)

SEQ ID NO: 4944 - DNA, 1550 bp, Leclercia sp. LSNIH8; identical to SEQ ID NO: 4942
  ref <308>: DATABASE ACCESSION NUMBER: NCBI ACCESSION: NZ_PQJY01000032.1
  ref <309>: DATABASE ENTRY DATE: 2019-04-01
  ref <313>: RELEVANT RESIDUES IN SEQ ID NO: (1)..(1550)

SEQ ID NO: 4945 - DNA, 1545 bp, Legionella cherrii
  ref <308>: DATABASE ACCESSION NUMBER: NCBI ACCESSION: NZ_LR134173.1
  ref <309>: DATABASE ENTRY DATE: 2019-04-01
  ref <313>: RELEVANT RESIDUES IN SEQ ID NO: (1)..(1545)
gaactgaagagtttgatcctggctcagattgaacgctggcggcatgcttaacacatgcaagtcgaacggcagcatggtctagcttgctagactgatggcgagtggcgaacgggtgagtaacgcgtaggaatatgccttgaagtgggggacaacttggggaaactcaagctaataccgcataatatctaaggatgaaagctggggaccttcgggcctggcgctttaagattagcctgcgtccgattagctagttggtggggtaagggcctaccaaggcgacgatcggtagctggtctgagaggatggccagccacactggaactgagacacggtccagactcctacgggaggcagcagtggggaatattggacaatgggggcaaccctgatccagcaatgccgcgtgtgtgaagaaggcctgagggttgtaaagcactttcagtagggaggagggcatttaggttaagagctagaatgttggacgttacctacagaagaagcaccggctaactccgtgccagcagccgcggtaatacggagggtgcaagcgttaatcggaattactgggcgtaaagcgtgcgtaggtggttgattaagttatctgtgaaatccctgggcttaacctgggcaggtcagatgatactggttgactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgccgtaaacgatgtcaactagctgttggttatatgaaaataattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttgtccttagttgccagcgcgtaaaggcgggaactctaaggagactgccggtgacaaaccggaggaaggcggggatgacgtcaagtcatcatggcccttacgggtagggctacacacgtgctacaatgggcgatacagagggaagcgaaggggtgacctggagctaatcttagaaagtcgctcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccttcgggaggacgtttaccacggtgtggttcatgactggggtgaagtcgtaacaaggtagccgtaggggaacctgcggctggatcacctccttaa

SEQ ID NO: 4946 - DNA, 1546 bp, Legionella hackeliae
  ref <308>: DATABASE ACCESSION NUMBER: NCBI ACCESSION: NZ_UGOC01000002.1
  ref <309>: DATABASE ENTRY DATE: 2019-04-01
  ref <313>: RELEVANT RESIDUES IN SEQ ID NO: (1)..(1546)
gaactgaagagtttgatcctggctcagattgaacgctggcggcatgcttaacacatgcaagtcgaacggcagcattttctagcttgctaggaagatggcgagtggcgaacgggtgagtaacgcgtaggaatatgccttaaagagggggacaacctggggaaactcaggctaataccgcataatttctgaggaaaaaagctggggaccgcaaggcctggcgctttaagattagcctgcgtccgattagctagttggtggggtaagggcctaccaaggcgacgatcggtagctggtctgagaggatgatcagccacactgggactgagacacggcccagactcctacgggaggcagcagtggggaatattggacaatggggggaaccctgatccagcaatgccgcgtgtgtgaagaaggcctgagggttgtaaagcactttcagtggggaggagattaggttaggttaagagctagacttaaggacgttacccacagaagaagcaccggctaactccgtgccagcagccgcggtaatacggagggtgcaagcgttaatcggaattactgggcgtaaagggtgcgtaggtggtttaataagttagttgtgaaatccctgggcttaacctgggaattgcacctaagactgttagactggagtataggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggtcttataaatgagattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttgtccttagttgccagcatgtaatggtggggactctaaggagactgccggtgacaaaccggaggaaggcggggatgacgtcaagtcatcatggcccttacgggtagggctacacacgtgctacaatggccggtacagagggaagcgaaggggcgacctggagcaaatccttaaaagctggtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgcaccagaagtagatagtctaaccttcggggggacgtttaccacggtgtgattcatgactggggtgaagtcgtaacaaggtagccgtaggggaacctgcggctggatcacctccttaa

SEQ ID NO: 4947 - DNA, 1547 bp, Legionella jordanis
  ref <308>: DATABASE ACCESSION NUMBER: NCBI ACCESSION: NZ_LR134383.1
  ref <309>: DATABASE ENTRY DATE: 2019-04-01
  ref <313>: RELEVANT RESIDUES IN SEQ ID NO: (1)..(1547)
gaactgaagagtttgatcctggctcagattgaacgctggcggcatgcttaacacatgcaagtcgaacggcagcatgacctagcttgctaggttgatggcgagtggcgaacgggtgagtaacgcgtaggaatatgccttaaagagggggataacctggggaaactcaggctaataccgcgtaatttctttggaaaaaagctggggaccgtaaggcctggcgctttaagattagcctgcgtccgattagctagttggtggggtaagggcctaccaaggcgacgatcggtagctggtctgagaggatgatcagccacactgggactgagacacggcccagactcctacgggaggcagcagtggggaatattggacaatgggggcaaccctgatccagcaatgccgcgtgtgtgaagaaggcctgagggttgtaaagcactttcagtggggaggagtggttagaaggttaagagccatttgactggacgttacccacagaagaagcaccggctaactccgtgccagcagccgcggtaatacggagggtgcgagcgttaatcggaattactgggcgtaaagggtgcgtaggtggtttggtaagttagttgtgaaatccctgggctcaacctgggaatggcgactaagactgccaggcttagagtataggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggtcttataaatgagattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttgtccttagttgccatcaagtgaagttggggactctaaggagactgccggtgacaaaccggaggaaggcggggatgacgtcaagtcatcatggcccttacgggtagggctacacacgtgctacaatggctggtacagaaggaagcgaaggggcgacctggagcaaatcctagaaagctggtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgcaccagaagtagatagtctaaccttaggggggacgtttaccacggtgtgattcatgactggggtgaagtcgtaacaaggtagccgtaggggaacctgcggctggatcacctccttaa

SEQ ID NO: 4948 - DNA, 1548 bp, Legionella longbeachae
  ref <308>: DATABASE ACCESSION NUMBER: NCBI ACCESSION: NZ_UGOF01000001.1
  ref <309>: DATABASE ENTRY DATE: 2019-04-01
  ref <313>: RELEVANT RESIDUES IN SEQ ID NO: (1)..(1548)
attgaactgaagagtttgatcctggctcagattgaacgctggcggcatgcttaacacatgcaagtcgaacggcagcacggactagtttactagttgggtggcgagtggcggacgggtgagtaacgcgtaggaatatgccttaaagagtgggacaacctggggaaactcaggctaataccgcatgaactctgaggaggaaagctggggaccgtaaggcctggcgctttaagagtagcctgcgtccgattagctagttggtggggtaagggcctaccaaggcgacgatcggtagctggtctgagaggatgatcagccacactgggactgagacacggcccagactcctacgggaggcagcagtggggaatattggacaatggggggaaccctgatccagcaatgccgcgtgtgtgaagaaggcctgagggttgtaaagcacttttgttggggaggagtcttgttaggttaagagctagatgagaggacgttacccaaagaaaaagcaccggctaactccgtgccagcagccgcggtaatacggagggtgcgagcgttaatcggaattactgggcgtaaagggtgcgtaggttgctgattaagttatctgtgaaattcctgggctcaacctggggtggtcagataagactggttagctggagtataggagagggtagtggaatttccggtgtagcggtgaaatgcgtagagatcggaaggaacaccagtggcgaaggcggctacctggcctaatactgacactgaggcacgaaagcgtggggagcgaacaggattagataccctggtagtccacgctgtaaacgatgtcaactagctgttggtcatataaatgtgattagtggcgtagcaaacgcgctaagttgaccgcctggggagtacggtcgcaagattaaaactcaaaggaattgacgggggcccgcacaagcggtggagcatgtggtttaattcgatgcaacgcgaagaaccttacctacccttgacatacagtggagcttgcagagatgtgggtgtgccttcgggaacactgctacaggtgctgcatggctgtcgtcagctcgtgtcgtgagatgttgggttaagtcccgtaacgagcgcaacccttattcttagttgccagcgcgtgaaggcgggaactctaaggagactgccggtgacaaaccggaggaaggcggggatgacgtcaagtcatcatggcccttacgggtagggctacacacgtgctacaatggccggtacagagggcggcgaaggggtgacctggagcaaatccttgaaagctggtcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagcggatagtctaaccttcggggggacgtttgccacggtgtggttcatgactggggtgaagtcgtaacaaggtagccgtaggggaacctgcggctggatcacctccttaa

SEQ ID NO: 4949 - DNA, 1545 bp, Legionella massiliensis
  ref <308>: DATABASE ACCESSION NUMBER: NCBI ACCESSION: NZ_CCVW01000001.1
  ref <309>: DATABASE ENTRY DATE: 2019-04-01
  ref <313>: RELEVANT RESIDUES IN SEQ ID NO: (1)..(1545)
gaactgaagagtttgatcctggctcagattgaacgctggcggcatgcttaacacatgcaagtcgaacggcagcatgatctagcttgctagattgatggcgagtggcgaacgggtgagtaacgcgtaggaatataccttagagagggggataacatggggaaactcatgctaataccgcatacgttcttcggaataaagctggggaccttcgggcctggcgctttaagaatagcctgcgtccgattagctagttggtagggtaagggcctaccaaggcgacgatcggtagctggtctgagaggatggccagccacactgggactgagacacggcccagactcctacgggaggcagcagtggggaatattggacaatggggggaaccctgatccagcaatgccgcgtgtgtgaagaaggcctgagggttgtaaagcactttcagtggggaggagggttgataggttaagagctaattaactggacgttacccacagaagaagcaccggctaactccgtgccagcagccgcggtaatacggagggtgcaagcgttaatcggaattactgggcgtaaagggtgcgtaggtggttatgtaagttatctgtgaaatccccgggctcaacctgggcaggtcagataagactgcgtaactcgagtatgggagagggtagtggaatttccggtgtagcggtgaaatgcgtagagatcggaaggaacaccagtggcgaaggcggctacctggcccaatactgacactgaggcacgaaagcgtggggagcaaacaggattagataccctggtagtccacgccgtaaacgatgtcaactagctgttggccttatgaatgaggttagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgtggaagtgccttcgggaacactgatacaggtgctgcatggctgtcgtcagctcgtgtcgtgagatgttgggttaagtcccgtaacgagcgcaacccttatccttagttaccagcacgttgaggtggggactctaaggagactgccggtgacaaaccggaggaaggcggggatgacgtcaagtcatcatggcccttacgggtagggctacacacgtgctacaatggccggtacagagggcagcgaaggggcgacctggagcaaatcttttaaagctggtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgcaccagaagtagatagtctaaccttcgggaggacgtttaccacggtgtgattcatgactggggtgaagtcgtaacaaggtagccgtaggggaacctgcggctggatcacctccttaa

SEQ ID NO: 4950 - DNA, 1545 bp, Legionella moravica
  ref <308>: DATABASE ACCESSION NUMBER: NCBI ACCESSION: NZ_UGOG01000001.1
  ref <309>: DATABASE ENTRY DATE: 2019-04-01
  ref <313>: RELEVANT RESIDUES IN SEQ ID NO: (1)..(1545)
gaactgaagagtttgatcctggctcagattgaacgctggcggcatgcttaacacatgcaagtcgaacggcagcatgacctagcttgctaggttgatggcgagtggcgaacgggtgagtaacgcgtaggaatataccttaaagagggggacaacttggggaaactcaagctaataccgcataatttccttggaaaaaagctggggaccttcgggcctggcgctttaagattagcctgcgtacgattagctagttggtagggtaaaggcctaccaaggcgacgatcgttagctggtctgagaggatgaccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggagggttgacaggttaagagctagttaactggacgttacccacagaagaagcaccggctaactccgtgccagcagccgcggtaatacggagggtgcaagcgttaatcggaattactgggcgtaaagggtgcgtaggtggttaattaagttatctgtgaaatccccgggctcaacctgggcaggtcagataatactggttaactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggatatatgaatatatttagtggcgaagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtggattttgcagagatgcattagtgccttcgggaacactgatacaggtgctgcatggctgtcgtcagctcgtgtcgtgagatgttgggttaagtcccgtaacgagcgcaacccttatccttagttgccagcacgtaatggtgggaactctaaggagactgccggtgacaaaccggaggaaggcggggatgacgtcaagtcatcatggcccttacgggtagggctacacacgtgctacaatggccgatacagagggcagcgaaggggcgacctggagcaaatcttttaaagtcggtcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccgcaagggggacgtttaccacggtgtggttcatgactggggtgaagtcgtaacaaggtagccgtaggggaacctgcggctggatcacctccttaa

SEQ ID NO: 4951 - DNA, 1545 bp, Legionella pneumophila
  ref <308>: DATABASE ACCESSION NUMBER: NCBI ACCESSION: NZ_LR134380.1
  ref <309>: DATABASE ENTRY DATE: 2019-04-01
  ref <313>: RELEVANT RESIDUES IN SEQ ID NO: (1)..(1545)
gaactgaagagtttgatcctggctcagattgaacgctggcggcatgcttaacacatgcaagtcgaacggcagcattgtctagcttgctagacagatggcgagtggcgaacgggtgagtaacgcgtaggaatatgccttgaagagggggacaacttggggaaactcaagctaataccgcataatatctttggatgaaagctggggaccttcgggcctggcgctttaagattagcctgcgtccgattagctagttggtggggtaagggcctaccaaggcgacgatcggtagctggtctgagaggatggccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggaggattgataggttaagagctgattgattggacgttacccacagaagaagcaccggctaactccgtgccagcagccgcggtaatacggagggtgcgagcgttaatcggaattactgggcgtaaagggtgcgtaggtggttgattaagttatctgtgaaattcctgggcttaacctgggacggtcagataatactggttgactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggttatatgaaaataattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtggattttgcagagatgcattagtgccttcgggaacactgatacaggtgctgcatggctgtcgtcagctcgtgtcgtgagatgttgggttaagtcccgtaacgagcgcaacccttatccttagttgccagcatgtgatggtggggactctaaggagactgccggtgacaaaccggaggaaggcggggatgacgtcaagtcatcatggcccttacgggtagggctacacacgtgctacaatggccgatacagagggcggcgaaggggcgacctggagcaaatccttaaaagtcggtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgcaccagaagtagatagtctaacctttggggggacgtttaccacggtgtggttcatgactggggtgaagtcgtaacaaggtagccgtaggggaacctgcggctggatcacctccttaa

SEQ ID NO: 4952 - DNA, 1545 bp, Legionella quateirensis
  ref <308>: DATABASE ACCESSION NUMBER: NCBI ACCESSION: NZ_UGOW01000001.1
  ref <309>: DATABASE ENTRY DATE: 2019-04-01
  ref <313>: RELEVANT RESIDUES IN SEQ ID NO: (1)..(1545)
gaactgaagagtttgatcctggctcagattgaacgctggcggcatgcttaacacatgcaagtcgaacggcagcatgacctagcttgctaggttgatggcgagtggcgaacgggtgagtaacgcgtaggaatataccttaaagagggggacaacttggggaaactcaagctaataccgcataatttccttggaaaaaagctggggaccttcgggcctggcgctttaagattagcctgcgtacgattagctagttggtagggtaaaggcctaccaaggcgacgatcgttagctggtctgagaggatgaccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggagggttgacaggttaagagctagttaactggacgttacccacagaagaagcaccggctaactccgtgccagcagccgcggtaatacggagggtgcaagcgttaatcggaattactgggcgtaaagggtgcgtaggtggttaattaagttatctgtgaaatccccgggctcaacctgggcaggtcagataatactggttaactcgagtatgggagagggtagtggaatttccggtgtagcggtgaaatgcgtagagatcggaaggaacaccagtggcgaaggcggctacctggcccaatactgacactgaggcacgaaagcgtggggagcaaacaggattagataccctggtagtccacgccgtaaacgatgtcaactagctgttggatatatgaatatatttagtggcgaagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtggattttgcagagatgcattagtgccttcgggaacactgatacaggtgctgcatggctgtcgtcagctcgtgtcgtgagatgttgggttaagtcccgtaacgagcgcaacccttatccttagttgccagcacgtaatggtgggaactctaaggagactgccggtgacaaaccggaggaaggcggggatgacgtcaagtcatcatggcccttacgggtagggctacacacgtgctacaatggccgatacagagggcagcgaaggggcgacctggagcaaatcttttaaagtcggtcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccgcaaggaggacgtttaccacggtgtggttcatgactggggtgaagtcgtaacaaggtagccgtaggggaacctgcggctggatcacctccttaa

SEQ ID NO: 4953 - DNA, 1545 bp, Legionella sainthelensi
  ref <308>: DATABASE ACCESSION NUMBER: NCBI ACCESSION: NZ_LR134388.1
  ref <309>: DATABASE ENTRY DATE: 2019-04-01
  ref <313>: RELEVANT RESIDUES IN SEQ ID NO: (1)..(1545)
gaactgaagagtttgatcctggctcagattgaacgctggcggcatgcttaacacatgcaagtcgaacggcagcatgacctagcttgctaggttgatggcgagtggcgaacgggtgagtaacgcgtaggaatatgccttgaagactgggataacttggggaaactcaagctaataccggatgatgtcttaggacgaaagctggggaccttcgggcctggcgctttaagattagcctgcgtccgattagctagttggtggggtaagggcctaccaaggcgacgatcggtagctggtctgagaggatggccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggagggttgataggttaagagctaattgattggacgttacccacagaagaagcaccggctaactccgtgccagcagccgcggtaatacggagggtgcaagcgttaatcggaattactgggcgtaaagcgtgcgtaggtggttaattaagttatctgtgaaatccctgggcttaacctgggcaggtcagatgatactggttaactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgccgtaaacgatgtcaactagctgttggatatatgaatatatttagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttgtccttagttgccagcacgtaaaggtgggaactctaaggagactgccggtgacaaaccggaggaaggcggggacgacgtcaagtcatcatggcccttacgggtagggctacacacgtgctacaatggacgatacagagggaagcgaaggggtgacctggagccaatcttagaaagtcgttcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccttcggggggacgtttaccacggtgtggttcatgactggggtgaagtcgtaacaaggtagccgtaggggaacctgcggctggatcacctccttaa

SEQ ID NO: 4954 - DNA, 1545 bp, Legionella sp. 13.8642
  ref <308>: DATABASE ACCESSION NUMBER: NCBI ACCESSION: NZ_UFAM01000077.1
  ref <309>: DATABASE ENTRY DATE: 2019-04-01
  ref <313>: RELEVANT RESIDUES IN SEQ ID NO: (1)..(1545)
gaactgaagagtttgatcctggctcagattgaacgctggcggcatgcttaacacatgcaagtcgaacggcagcatgacctagcttgctaggttgatggcgagtggcgaacgggtgagtaacgcgtaggaatatgccttgaagactgggataacttggggaaactcaagctaataccggatgatgtcttaggacgaaagctggggacctttgggcctggcgctttaagattagcctgcgtccgattagctagttggtggggtaagggcctaccaaggcgacgatcggtagctggtctgagaggatggccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggaggattgataggttaagagctaattgattggacgttacccacagaagaagcaccggctaactccgtgccagcagccgcggtaatacggagggtgcaagcgttaatcggaattactgggcgtaaagcgtgcgtaggtggttaattaagttatctgtgaaatccctgggcttaacctgggcaggtcagatgatactggttgactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgccgtaaacgatgtcaactagctgttggatatatgaatatatttagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttgtccttagttgccagcacgtaaaggtgggaactctaaggagactgccggtgacaaaccggaggaaggcggggacgacgtcaagtcatcatggcccttacgggtagggctacacacgtgctacaatggacgatacagagggaagcgaaggggtgacctggagccaatcttagaaagtcgttcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccttcggggggacgtttaccacggtgtggttcatgactggggtgaagtcgtaacaaggtagccgtaggggaacctgcggctggatcacctccttaa

SEQ ID NO: 4955 - DNA, 1545 bp, Legionella sp. km489
  ref <308>: DATABASE ACCESSION NUMBER: NCBI ACCESSION: NZ_RZGX01000045.1
  ref <309>: DATABASE ENTRY DATE: 2019-04-01
  ref <313>: RELEVANT RESIDUES IN SEQ ID NO: (1)..(1545)
gaactgaagagtttgatcctggctcagattgaacgctggcggcatgcttaacacatgcaagtcgaacggcagcacatactagcttgctagtagggtggcgagtggcgaacgggtgagtaacgcgtaggaatatgccttgaagtgggggacaacttggggaaactcaagctaataccgcataatatctaaggatgaaagctggggaccttcgggcctggcgctttaagattagcctgcgtccgattagctagttggtggggtaaaggcctaccaaggcgacgatcggtagctggtctgagaggatggccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggagggttattaggttaagagctagatgactggacgttacccacagaagaagcaccggctaactccgtgccagcagccgcggtaatacggagggtgcaagcgttaatcggaattactgggcgtaaagcgtgcgtaggtggttgattaagttatctgtgaaatccctgggcttaacctgggcaggtcagatgatactggttgactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgccgtaaacgatgtcaactagctgttggttatatgaaaataattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaattttgcagagatgcattagtgccttcgggaacactgatacaggtgctgcatggctgtcgtcagctcgtgtcgtgagatgttgggttaagtcccgtaacgagcgcaacccttgtccttagttgccagcacgtaaaggtgggaactctaaggagactgccggtgacaaaccggaggaaggcggggatgacgtcaagtcatcatggcccttacgggtagggctacacacgtgctacaatgggtgatacagatggaagcgaaggggtgacctggagctaatcttagaaagtcgctcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccttcgggaggacgtttaccacggtgtggttcatgactggggtgaagtcgtaacaaggtagccgtaggggaacctgcggctggatcacctccttaa

SEQ ID NO: 4956 - DNA, 1545 bp, Legionella sp. km521; identical to SEQ ID NO: 4955
  ref <308>: DATABASE ACCESSION NUMBER: NCBI ACCESSION: NZ_RZGW01000045.1
  ref <309>: DATABASE ENTRY DATE: 2019-04-01
  ref <313>: RELEVANT RESIDUES IN SEQ ID NO: (1)..(1545)

SEQ ID NO: 4957 - DNA, 1547 bp, Legionella sp. km524
  ref <308>: DATABASE ACCESSION NUMBER: NCBI ACCESSION: NZ_RZGV01000067.1
  ref <309>: DATABASE ENTRY DATE: 2019-04-01
  ref <313>: RELEVANT RESIDUES IN SEQ ID NO: (1)..(1547)
gaactgaagagtttgatcctggctcagattgaacgctggcggcatgcttaacacatgcaagtcgaacggcagcatggcctagcttgctaggttgatggcgagtggcgaacgggtgagtaacgcgtaggaatatgccctggagagggggataacttggggaaactcaagctaataccgcatgaactctgaggagcgaagctggggaccttagggcctggcgcttcaggaatagcctgcgtctgattagctagttggtggggtaagggcctaccaaggcgacgatcggtagctggtctgagaggatgatcagccacactgggactgagacacggcccagactcctacgggaggcagcagtggggaatattggacaatggggggaaccctgatccagcaatgccgcgtgtgtgaagaaggcctgagggttgtaaagcacttttgttggggaggagtcttggatggttaagagctgtttaagaggacgttacccaaagaataagcaccggctaactccgtgccagcagccgcggtaatacggagggtgcgagcgttaatcggaattactgggcgtaaagggtgcgtaggtggtatgataagtcgtctgtgaaagacctgggcttaacctgggttggtcagatgatactgttgtactcgagtatgggagagggtagtggaatttccggtgtagcggtgaaatgcgtagagatcggaaggaacaccagtggcgaaggcggctacctggcctgatactgacactgaggcacgaaagcgtggggagcaaacaggattagataccctggtagtccacgctgtaaacgatgtcaactagctgttggtcatatgaatgtgattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaactttgcagagatgtggaggtgccttcgggagcactgatacaggtgctgcatggctgtcgtcagctcgtgtcgtgagatgttgggttaagtcccgtaacgagcgcaacccttattcttagttaccagcacgttgaggtggggactctaaggagactgccggtgacaaaccggaggaaggcggggatgacgtcaagtcatcatggcccttacgggtagggctacacacgtgctacaatggccggtacagagggcggcgaaggggtgacctggagcaaatctttgaaagctggtcgtagtccggattgaagtctgcaactcgacttcatgaagtcggaatcgctagtaatcgcgaatcagcatgtcgcggtgaatacgttcccgggccttgtacacaccgcccgtcacaccatgggagtgggttgcaccagaagtagatagtctaaccttaggggggacgtttaccacggtgtggttcatgactggggtgaagtcgtaacaaggtagccgtaggggaacctgcggctggatcacctccttaaaa

SEQ ID NO: 4958 - DNA, 1545 bp, Legionella sp. km535
  ref <308>: DATABASE ACCESSION NUMBER: NCBI ACCESSION: NZ_RZGU01000053.1
  ref <309>: DATABASE ENTRY DATE: 2019-04-01
  ref <313>: RELEVANT RESIDUES IN SEQ ID NO: (1)..(1545)
gaactgaagagtttgatcctggctcagattgaacgctggcggcatgcttaacacatgcaagtcgaacggcagcatgacctagcttgctaggttgatggcgagtggcgaacgggtgagtaacgcgtaggaatataccttaaagagggggacaacttggggaaactcaagctaataccgcataatttccttggaaaaaagctggggaccttcgggcctggcgctttaagattagcctgcgtacgattagctagttggtagggtaaaggcctaccaaggcgacgatcgttagctggtctgagaggatgaccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggagggttgacaggttaagagctggttgactggacgttacccacagaagaagcaccggctaactccgtgccagcagccgcggtaatacggagggtgcaagcgttaatcggaattactgggcgtaaagggtgcgtaggtggttaattaagttatctgtgaaatccccgggctcaacctgggcaggtcagataatactggttaactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggatatatgaatatatttagtggcgaagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtggattttgcagagatgcattagtgccttcgggaacactgatacaggtgctgcatggctgtcgtcagctcgtgtcgtgagatgttgggttaagtcccgtaacgagcgcaacccttatccttagttgccagcacgtaatggtgggaactctaaggagactgccggtgacaaaccggaggaaggcggggatgacgtcaagtcatcatggcccttacgggtagggctacacacgtgctacaatggccgatacagagggcagcgaaggggcgacctggagcaaatcttttaaagtcggtcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccgcaaggaggacgtttaccacggtgtggttcatgactggggtgaagtcgtaacaaggtagccgtaggggaacctgcggctggatcacctccttaa

SEQ ID NO: 4959 - DNA, 1470 bp, Legionella sp. km542
  ref <308>: DATABASE ACCESSION NUMBER: NCBI ACCESSION: NZ_RZGT01000048.1
  ref <309>: DATABASE ENTRY DATE: 2019-04-01
  ref <313>: RELEVANT RESIDUES IN SEQ ID NO: (1)..(1470)
cctagcttgctaggttgatggcgagtggcgaacgggtgagtaacgcgtaggaatatgccctggagagggggataacttggggaaactcaagctaataccgcatgaactctgaggagcgaagctggggaccttagggcctggcgcttcaggaatagcctgcgtctgattagctagttggtggggtaagggcctaccaaggcgacgatcggtagctggtctgagaggatgatcagccacactgggactgagacacggcccagactcctacgggaggcagcagtggggaatattggacaatggggggaaccctgatccagcaatgccgcgtgtgtgaagaaggcctgagggttgtaaagcacttttgttggggaggagtcttggatggttaagagctgtttaagaggacgttacccaaagaataagcaccggctaactccgtgccagcagccgcggtaatacggagggtgcgagcgttaatcggaattactgggcgtaaagggtgcgtaggtggtatgataagtcgtctgtgaaagacctgggcttaacctgggttggtcagatgatactgttgtactcgagtatgggagagggtagtggaatttccggtgtagcggtgaaatgcgtagagatcggaaggaacaccagtggcgaaggcggctacctggcctgatactgacactgaggcacgaaagcgtggggagcaaacaggattagataccctggtagtccacgctgtaaacgatgtcaactagctgttggtcatatgaatgtgattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaactttgcagagatgtggaggtgccttcgggagcactgatacaggtgctgcatggctgtcgtcagctcgtgtcgtgagatgttgggttaagtcccgtaacgagcgcaacccttattcttagttaccagcacgttgaggtggggactctaaggagactgccggtgacaaaccggaggaaggcggggatgacgtcaagtcatcatggcccttacgggtagggctacacacgtgctacaatggccggtacagagggcggcgaaggggtgacctggagcaaatctttgaaagctggtcgtagtccggattgaagtctgcaactcgacttcatgaagtcggaatcgctagtaatcgcgaatcagcatgtcgcggtgaatacgttcccgggccttgtacacaccgcccgtcacaccatgggagtgggttgcaccagaagtagatagtctaaccttaggggggacgtttaccacggtgtggttcatgactggggtgaagtcgtaacaaggtagccgtaggggaacctgcggctggatcacctccttaaaa

SEQ ID NO: 4960 - DNA, 1425 bp, Legionella sp. km711
  ref <308>: DATABASE ACCESSION NUMBER: NCBI ACCESSION: NZ_RZGS01000075.1
  ref <309>: DATABASE ENTRY DATE: 2019-04-01
  ref <313>: RELEVANT RESIDUES IN SEQ ID NO: (1)..(1425)
gaactgaagagtttgatcctggctcagattgaacgctggcggcatgcttaacacatgcaagtcgaacggcagcatggcctagcttgctaggttgatggcgagtggcgaacgggtgagtaacgcgtaggaatatgccctggagagggggataacttggggaaactcaagctaataccgcatgaactctgaggagcgaagctggggaccttagggcctggcgcttcaggaatagcctgcgtctgattagctagttggtggggtaagggcctaccaaggcgacgatcggtagctggtctgagaggatgatcagccacactgggactgagacacggcccagactcctacgggaggcagcagtggggaatattggacaatggggggaaccctgatccagcaatgccgcgtgtgtgaagaaggcctgagggttgtaaagcacttttgttggggaggagtcttggatggttaagagctgtttaagaggacgttacccaaagaataagcaccggctaactccgtgccagcagccgcggtaatacggagggtgcgagcgttaatcggaattactgggcgtaaagggtgcgtaggtggtatgataagtcgtctgtgaaagacctgggcttaacctgggttggtcagatgatactgttgtactcgagtatgggagagggtagtggaatttccggtgtagcggtgaaatgcgtagagatcggaaggaacaccagtggcgaaggcggctacctggcctgatactgacactgaggcacgaaagcgtggggagcaaacaggattagataccctggtagtccacgctgtaaacgatgtcaactagctgttggtcatatgaatgtgattagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaactttgcagagatgtggaggtgccttcgggagcactgatacaggtgctgcatggctgtcgtcagctcgtgtcgtgagatgttgggttaagtcccgtaacgagcgcaacccttattcttagttaccagcacgttgaggtggggactctaaggagactgccggtgacaaaccggaggaaggcggggatgacgtcaagtcatcatggcccttacgggtagggctacacacgtgctacaatggccggtacagagggcggcgaaggggtgacctggagcaaatctttgaaagctggtcgtagtccggattgaagtctgcaactcgacttcatgaagtcggaatcgctagtaatcgcgaatcagcatgtcgcggtgaatacgttcccgggccttgtacacaccgcccgtcacaccatgggagtggg

SEQ ID NO: 4961 - DNA, 1470 bp, Legionella sp. km714; identical to SEQ ID NO: 4959
  ref <308>: DATABASE ACCESSION NUMBER: NCBI ACCESSION: NZ_RZGR01000078.1
  ref <309>: DATABASE ENTRY DATE: 2019-04-01
  ref <313>: RELEVANT RESIDUES IN SEQ ID NO: (1)..(1470)

SEQ ID NO: 4962 - DNA, 1459 bp, Legionella sp. km772
  ref <308>: DATABASE ACCESSION NUMBER: NCBI ACCESSION: NZ_RZGQ01000328.1
  ref <309>: DATABASE ENTRY DATE: 2019-04-01
  ref <313>: RELEVANT RESIDUES IN SEQ ID NO: (1)..(1459)
gaactgaagagtttgatcctggctcagattgaacgctggcggcatgcttaacacatgcaagtcgaacggcagcacgaactagcttgctagttgggtggcgagtggcgaacgggtgagtaacgcgtaggaatatgccttgcagtgggggacaacttggggaaactcaagctaataccgcatagtatcttaggattaaagctggggaccttcgggcctggcgctgtaagattagcctgcgtacgattagctagttggtggggtaagggcctaccaaggcgacgatcgttagctggtctgagaggatgaccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggaggattgttaggttaagagctagacaattggacgttacccacagaagaagcaccggctaactccgtgccagcagccgcggtaatacggagggtgcgagcgttaatcggaattactgggcgtaaagggtgcgtaggtggtatggtaagttatctgtgaaatccctgggctcaacctgggcaggtcagataatactgctgtactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggctatatgaatatagttagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtggaacttgcagagatgtgagtgtgccttcgggaacactgatacaggtgctgcatggctgtcgtcagctcgtgtcgtgagatgttgggttaagtcccgtaacgagcgcaacccttatccttagttgccagcacgtaatggtgggaactctaaggagactgccggtgacaaaccggaggaaggcggggatgacgtcaagtcatcatggcccttacgggtagggctacacacgtgctacaatggttgatacagagggcagcgaaggggcgacctggagcaaatcttttaaagtcaatcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagtagatagtctaacccttcgggg

SEQ ID NO: 4963 - DNA, 1547 bp, Legionella spiritensis
  ref <308>: DATABASE ACCESSION NUMBER: NCBI ACCESSION: NZ_LR134374.1
  ref <309>: DATABASE ENTRY DATE: 2019-04-01
  ref <313>: RELEVANT RESIDUES IN SEQ ID NO: (1)..(1547)
gaactgaagagtttgatcctggctcagattgaacgctggcggcatgcttaacacatgcaagtcgaacggcagcatggtccagcttgctggactgatggcgagtggcgaacgggtgagtaacgcgtaggaatatgccttaaagagggggacaacttggggaaacccaagctaataccgcataatctctgaggagagaagctggggaccttcgggcctggcgctttaagattagcctgcgtccgattagctagttggtgaggtaagggctcaccaaggcgacgatcggtagctggtctgagaggatgaccagccacactgggactgagacacggcccagactcctacgggaggcagcagtggggaatattggacaatggggggaaccctgatccagcaatgccgcgtgtgtgaagaaggcctgagggttgtaaagcactttcagtggggaggagagttgagtggttaagagctgtttgactggacgttacccacagaagaagcaccggctaactccgtgccagcagccgcggtaatacggagggtgcaagcgttaatcggaattactgggcgtaaagggtgcgtaggtggtttggtaagttaactgtgaaagccctgggcttaacctgggaattgcagttaagactgtcgaactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggccttataaatgaggttagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtgaatgatgcagagatgcgtcagtgccttcgggaatactgatacaggtgctgcatggctgtcgtcagctcgtgtcgtgagatgttgggttaagtcccgtaacgagcgcaacccttgtccttagttgccagcacgtaaaggtgggaactctagggagactgccggtgacaaaccggaggaaggcggggacgacgtcaagtcatcatggcccttacgggtagggctacacacgtgctacaatggccggtacagagggcagcgaaggggcgacctgtagcaaatccttaaaagctggtcgtagtccggattggagtctgcaactcgactccatgaagtcggaatcgctagtaatcgcgaatcagcatgtcgcggtgaatacgttcccgggccttgtacacaccgcccgtcacaccatgggagtgggttgcaccagaagtagatagtctaaccttcggggggacgtttaccacggtgtgattcatgactggggtgaagtcgtaacaaggtagccgtaggggaacctgcggctggatcacctccttaaaa

SEQ ID NO: 4964 - DNA, 1545 bp, Legionella worsleiensis
  ref <308>: DATABASE ACCESSION NUMBER: NCBI ACCESSION: NZ_UGPA01000001.1
  ref <309>: DATABASE ENTRY DATE: 2019-04-01
  ref <313>: RELEVANT RESIDUES IN SEQ ID NO: (1)..(1545)
gaactgaagagtttgatcctggctcagattgaacgctggcggcatgcttaacacatgcaagtcgaacggcagcatgacctagcttgctaggttgatggcgagtggcgaacgggtgagtaacgcgtaggaatataccttaaagagggggacaacttggggaaactcaagctaataccgcataatttctttggaaaaaagctggggaccttcgggcctggcgctttaagattagcctgcgtacgattagctagttggtagggtaaaggcctaccaaggcgacgatcgttagctggtctgagaggatgaccagccacactggaactgagacacggtccagactcctacgggaggcagcagtggggaatattggacaatgggggcaaccctgatccagcaatgccgcgtgtgtgaagaaggcctgagggttgtaaagcactttcagtggggaggaggattgattggttaagagctgattgattggacgttacccacagaagaagcaccggctaactccgtgccagcagccgcggtaatacggagggtgcaagcgttaatcggaattactgggcgtaaagggtgcgtaggtggttaattaagttatctgtgaaatccctgggctcaacctgggcaggtcagataatactggttaactcgagtatgggagagggtagtggaatttccggtgtagcggtgaaatgcgtagagatcggaaggaacaccagtggcgaaggcggctacctggcctaatactgacactgaggcacgaaagcgtggggagcaaacaggattagataccctggtagtccacgctgtaaacgatgtcaactagctgttggatatatgaatatatttagtggcgcagcaaacgcgataagttgaccgcctggggagtacggtcgcaagattaaaactcaaaggaattgacgggggcccgcacaagcggtggagcatgtggtttaattcgatgcaacgcgaagaaccttacctacccttgacatacagtggattttgcagagatgcattagtgccttcgggaacactgatacaggtgctgcatggctgtcgtcagctcgtgtcgtgagatgttgggttaagtcccgtaacgagcgcaacccttatccttagttgccagcacgtaatggtgggaactctaaggagactgccggtgacaaaccggaggaaggcggggatgacgtcaagtcatcatggcccttacgggtagggctacacacgtgctacaatggccgatacagagggcagcgaaggggcgacctggagcaaatcttagaaagtcggtcgtagtccggattggagtctgcaactcgactccatgaagtcggaatcgctagtaatcgcgaatcagcatgtcgcggtgaatacgttcccgggccttgtacacaccgcccgtcacaccatgggagtgggctgcaccagaagtagatagtctaaccgcaagggggacgtttaccacggtgtggttcatgactggggtgaagtcgtaacaaggtagccgtaggggaacctgcggctggatcacctccttaa

SEQ ID NO: 4965 - DNA, 1527 bp, Leifsonia aquatica
  ref <308>: DATABASE ACCESSION NUMBER: NCBI ACCESSION: NZ_AYMR01000006.1
  ref <309>: DATABASE ENTRY DATE: 2019-04-01
  ref <313>: RELEVANT RESIDUES IN SEQ ID NO: (1)..(1527)
tttacggagagtttgatcctggctcaggacgaacgctggcggcgtgcttaacacatgcaagtcgaacgatgaaccaggagcttgctcttggggattagtggcgaacgggtgagtaacacgtgagtaacctgcccttgactctgggataacctccggaaacggaagctaataccggatacgacccgcggaggcatctccagcgggtggaaagaacttcggtcaaggatggactcgcggcctatcaggtagttggtgaggtaaaggctcaccaagcctacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcgagcgttgtccggaattattgggcgtaaagagctcgtaggcggtctgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgtaactgacgctgaggagcgaaagcgtggggagcgaacaggattagataccctggtagtccacgccgtaaacgttgggcgctagatgtggggaccattccacggtttccgtgtcgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatatacgagaacgggctagaaatagtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcataggagactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgggatcggtgattaggactaagtcgtaacaaggtagccgtaccggaaggtgcggctggatcacctcctttcta

SEQ ID NO: 4966 - DNA, 1531 bp, Leifsonia sp. M321 24 2
  ref <308>: DATABASE ACCESSION NUMBER: NCBI ACCESSION: NZ_RCCO01000002.1
  ref <309>: DATABASE ENTRY DATE: 2019-04-01
  ref <313>: RELEVANT RESIDUES IN SEQ ID NO: (1)..(1531)
tttacggagagtttgatcctggctcaggacgaacgctggcggcgtgcttaacacatgcaagtcgaacgatgaacctggagcttgctccaggggattagtggcgaacgggtgagtaacacgtgagtaacctgcccttgactctgggataacctccggaaacggaagctaataccggatatgacgcacggaggcatctcctgtgcgtggaaagaatttcggtcaaggatggactcgcggcctatcaggtagttggtgaggtaacggctcaccaagcctacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcgagcgttgtccggaattattgggcgtaaagagctcgtaggcggtctgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgtaactgacgctgaggagcgaaagcgtggggagcgaacaggattagataccctggtagtccacgccgtaaacgttgggcgctagatgtggggaccattccacggtttccgtgtcgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacacgagaacgccctagaaatagggaactctttggacactcgtgaacaggtggtgcatggttgtcgtcagctcgtgtcgtgagatgttgggttaagtcccgcaacgagcgcaaccctcgttctatgttgccagcgcgtaatggcgggaactcataggagactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcccaacccttgtggagggagccgtcgaaggtgggatcggtgattaggactaagtcgtaacaaggtagccgtaccggaaggtgcggctggatcacctcctttctaagga

SEQ ID NO: 4967 - DNA, 1530 bp, Leifsonia sp. OV430
  ref <308>: DATABASE ACCESSION NUMBER: NCBI ACCESSION: NZ_RBIX01000008.1
  ref <309>: DATABASE ENTRY DATE: 2019-04-01
  ref <313>: RELEVANT RESIDUES IN SEQ ID NO: (1)..(1530)
tttatggagagtttgatcctggctcaggacgaacgctggcggcgtgcttaacacatgcaagtcgaacggtgaacttgggagcttgctcctgggggatcagtggcgaacgggtgagtaacacgtgagcaatctgcccttgactctgggataagcgttggaaacgacgtctaataccggatacgaccatccccggcatcgggaggtggtggaaagaattttggtcaaggatgagctcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcccaaccatttatggagggagctgtcgaaggtgggatcggtgattaggactaagtcgtaacaaggtagccgtaccggaaggtgcggctggatcacctcctttcta

SEQ ID NO: 4968 - DNA, 1527 bp, Leifsonia sp. ku-ls
  ref <308>: DATABASE ACCESSION NUMBER: NCBI ACCESSION: NZ_QKXI01000003.1
  ref <309>: DATABASE ENTRY DATE: 2019-04-01
  ref <313>: RELEVANT RESIDUES IN SEQ ID NO: (1)..(1527)
tttacggagagtttgatcctggctcaggacgaacgctggcggcgtgcttaacacatgcaagtcgaacgatgaaccaggagcttgctcttgggaattagtggcgaacgggtgagtaacacgtgagtaacctgcccttgactctgggataacctccggaaacggaagctaataccggatacgacgcacggaggcatctcctgtgcgtggaaagaacttcggtcaaggatggactcgcggcctatcaggtagttggtgaggtaacggcccaccaagcctacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcgagcgttgtccggaattattgggcgtaaagagctcgtaggcggtctgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgtaactgacgctgaggagcgaaagcgtggggagcgaacaggattagataccctggtagtccacgccgtaaacgttgggcgctagatgtggggaccattccacggtttccgtgtcgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacacgagaacgccctagaaatagggaactctttggacactcgtgaacaggtggtgcatggttgtcgtcagctcgtgtcgtgagatgttgggttaagtcccgcaacgagcgcaaccctcgttctatgttgccagcgcgtaatggcgggaactcataggagactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcccaacccttgtggagggagccgtcgaaggtgggatcggtgattaggactaagtcgtaacaaggtagccgtaccggaaggtgcggctggatcacctcctttcta

SEQ ID NO: 4969 - DNA, 1469 bp, Leisingera aquaemixtae
  ref <308>: DATABASE ACCESSION NUMBER: NCBI ACCESSION: NZ_CYSR01000039.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgcccttcggggtgagcggcggacgggttagtaacgcgtgggaacgtgcccttctctaaggaatagccactggaaacggtgagtaataccttatacgcccttcgggggaaagatttatcggagaaggatcggcccgcgttagattaggtagttggtggggtaatggcctaccaagcctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcgcgtaggcggactggaaagttgggggtgaaatcccagggctcaaccctggaactgcctccaaaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcggctagcatgctagtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctcggaccgccagagagatctggttttcacttcggtgaccgagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcggcggcatgaagtcggaatcgctagtaatcgcgtaacagcatgacgcggtgaatacgttcccgggccttgtacacaccgcccgtcacaccatgggagttgggtttacccgaaggccgtgcgccaacctttcgaggaggcagcggaccacggtgagctcagcgactggggtgaagtcgtaacaaggtagccgtaggggaacctgcggctggatcacctcctttctaa

SEQ ID NO: 4970 - DNA, 1467 bp, Leisingera aquimarina
  ref <308>: DATABASE ACCESSION NUMBER: NCBI ACCESSION: NZ_KI421504.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgctctccttcgggagggagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggaccagaaagtaaggggtgaaatcccagggctcaaccctggaactgcctcttaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccggcccagagatgggtctttcacttcggtgaccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcggcggcatgaagtcggaatcgctagtaatcgcgtaacagcatgacgcggtgaatacgttcccgggccttgtacacaccgcccgtcacaccatgggagttgggtttacccgaaggccgtgcgctaacttttgaggcagcggaccacggtgagctcagcgactggggtgaagtcgtaacaaggtagccgtaggggaacctgcggctggatcacctcctttctaa

SEQ ID NO: 4971 - DNA, 1469 bp, Leisingera caerulea
  ref <308>: DATABASE ACCESSION NUMBER: NCBI ACCESSION: NZ_KI421513.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcacccttcggggtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgcctgtgatgataatgacagtagcaggtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaactgcctccaaaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcccaggaccggcccagagatgggtctttcacttcggtgacctggtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcggcggcatgaagtcggaatcgctagtaatcgcgtaacagcatgacgcggtgaatacgttcccgggccttgtacacaccgcccgtcacaccatgggagttgggtttacccgaaggccgtgcgccaacctttcgaggaggcagcggaccacggtgagctcagcgactggggtgaagtcgtaacaaggtagccgtaggggaacctgcggctggatcacctcctttctaa

SEQ ID NO: 4972 - DNA, 1469 bp, Leisingera daeponensis
  ref <308>: DATABASE ACCESSION NUMBER: NCBI ACCESSION: NZ_KI421500.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgcccttcggggtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaacggcctccaaaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcccgggaccgccagagagatctggttttcacttcggtgacccggtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcggcggcatgaagtcggaatcgctagtaatcgcgtaacagcatgacgcggtgaatacgttcccgggccttgtacacaccgcccgtcacaccatgggagttgggtttacccgaaggccgtgcgccaacctttcgaggaggcagcggaccacggtgagctcagcgactggggtgaagtcgtaacaaggtagccgtaggggaacctgcggctggatcacctcctttctaa

SEQ ID NO: 4973 - DNA, 1473 bp, Leisingera methylohalidivorans
  ref <308>: DATABASE ACCESSION NUMBER: NCBI ACCESSION: NC_023135.1
  ref <309>: DATABASE ENTRY DATE: 2019-04-01
  ref <313>: RELEVANT RESIDUES IN SEQ ID NO: (1)..(1473)
tcaacttgagagtttgatcctggctcagaacgaacgctggcggcaggcctaacacatgcaagtcgagcgctctccttcgggagggagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggaccagaaagtaaggggtgaaatcccagggctcaaccctggaactgcctcttaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgccagagagatctggttttcacttcggtgaccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcggcggcatgaagtcggaatcgctagtaatcgcgtaacagcatgacgcggtgaatacgttcccgggccttgtacacaccgcccgtcacaccatgggagttgggtttacccgaaggccgtgcgccaaccacttcggtgggggcagcggaccacggtgagctcagcgactggggtgaagtcgtaacaaggtagccgtaggggaacctgcggctggatcacctcctttctaa

SEQ ID NO: 4974 - DNA, 1469 bp, Leisingera sp. ANG-DT
  ref <308>: DATABASE ACCESSION NUMBER: NCBI ACCESSION: NZ_JWLE01000035.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgcccttcggggtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgcctgtgatgataatgacagtagcaggtaaagaaaccccggctaactccgtgccagcagccgcggtaatacggagggggttagcgttgttcggaattactgggcgtaaagcgcgcgtaggcggattggaaagttgggggtgaaatcccagggctcaaccctggaactgcctccaaaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcggctagcatgctagtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgggaccgccagagagatctggtttccacttcggtggctcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcggcggcatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 4975 - DNA, 1467 bp, Leisingera sp. ANG-M1
  ref <308>: DATABASE ACCESSION NUMBER: NCBI ACCESSION: NZ_JWLC01000009.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcgcccttcggggtgagcggcggacgggttagtaacgcgtgggaacgtgcccagatctaaggaatagccactggaaacggtgagtaataccttatacgcccttcgggggaaagatttatcggatttggatcggcccgcgttagattaggtagttggtggggtaacggcctaccaagcctacgatctatagctggttttagaggatgatcagcaacactgggactgagacacggcccagactcctacgggaggcagcagtggggaatcttggacaatgggggcaaccctgatccagccatgccgcgtgagtgatgaaggccctagggtcgtaaagctctttcgcctgtgatgataatgacagtagcaggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggtagcatgctattcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgggaccgccagagagatctggtttccacttcggtggctcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcggcggcatgaagtcggaatcgctagtaatcgcgtaacagcatgacgcggtgaatacgttcccgggccttgtacacaccgcccgtcacaccatgggagttgggtttacccgaaggccgtgcgccaaccttttggaggcagcggaccacggtgagctcagcgactggggtgaagtcgtaacaaggtagccgtaggggaacctgcggctggatcacctcctttctaa

SEQ ID NO: 4976 - DNA, 1469 bp, Leisingera sp. ANG-M6; identical to SEQ ID NO: 4974
  ref <308>: DATABASE ACCESSION NUMBER: NCBI ACCESSION: NZ_JWLG01000024.1
  ref <309>: DATABASE ENTRY DATE: 2019-04-01
  ref <313>: RELEVANT RESIDUES IN SEQ ID NO: (1)..(1469)

SEQ ID NO: 4977 - DNA, 1469 bp, Leisingera sp. ANG-M7
  ref <308>: DATABASE ACCESSION NUMBER: NCBI ACCESSION: NZ_JWLI01000033.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgcccttcggggtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaactgcctccaaaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcggctagcatgctagtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgggaccgccagagagatctggtttccacttcggtggctcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcggcggcatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 4978 - DNA, 1469 bp, Leisingera sp. ANG-S; identical to SEQ ID NO: 4974
  ref <308>: DATABASE ACCESSION NUMBER: NCBI ACCESSION: NZ_JWLM01000010.1
  ref <309>: DATABASE ENTRY DATE: 2019-04-01
  ref <313>: RELEVANT RESIDUES IN SEQ ID NO: (1)..(1469)

SEQ ID NO: 4979 - DNA, 1469 bp, Leisingera sp. ANG-S3; identical to SEQ ID NO: 4974
  ref <308>: DATABASE ACCESSION NUMBER: NCBI ACCESSION: NZ_JWLF01000017.1
  ref <309>: DATABASE ENTRY DATE: 2019-04-01
  ref <313>: RELEVANT RESIDUES IN SEQ ID NO: (1)..(1469)

SEQ ID NO: 4980 - DNA, 1469 bp, Leisingera sp. ANG-S5; identical to SEQ ID NO: 4974
  ref <308>: DATABASE ACCESSION NUMBER: NCBI ACCESSION: NZ_JWLH01000022.1
  ref <309>: DATABASE ENTRY DATE: 2019-04-01
  ref <313>: RELEVANT RESIDUES IN SEQ ID NO: (1)..(1469)

SEQ ID NO: 4981 - DNA, 1469 bp, Leisingera sp. ANG1; identical to SEQ ID NO: 4974
  ref <308>: DATABASE ACCESSION NUMBER: NCBI ACCESSION: NZ_AFCF02000013.1
  ref <309>: DATABASE ENTRY DATE: 2019-04-01
  ref <313>: RELEVANT RESIDUES IN SEQ ID NO: (1)..(1469)

SEQ ID NO: 4982 - DNA, 1467 bp, Leisingera sp. JC1
  ref <308>: DATABASE ACCESSION NUMBER: NCBI ACCESSION: NZ_LYUZ01000001.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcgcccttcggggtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaamgctctttcgcctgtgatgataatgacagtagcaggtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaactgcctccaaaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcggctagcatgctagtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgggaccgccagagagatctggtttccacttcggtggctcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcggcggcatgaagtcggaatcgctagtaatcgcgtaacagcatgacgcggtgaatacgttcccgggccttgtacacaccgcccgtcacaccatgggagttgggtttacccgaaggccgtgcgccaaccttttggaggcagcggaccacggtgagctcagcgactggggtgaagtcgtaacaaggtagccgtaggggaacctgcggctggatcacctcctttctaa

SEQ ID NO: 4983 - DNA, 1471 bp, Leisingera sp. NJS204
  ref <308>: DATABASE ACCESSION NUMBER: NCBI ACCESSION: NZ_CP035417.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgctctcttcggagggagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggaccagaaagtaaggggtgaaatcccagggctcaaccctggaactgcctcttaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggaccgctggagagattcagctttctcgtaagagaccaggtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctcttcggagggggcagcggaccacggtgagctcagcgactggggtgaagtcgtaacaaggtagccgtaggggaacctgcggctggatcacctcctttctaa

SEQ ID NO: 4984 - DNA, 1554 bp, Lelliottia amnigena
  ref <308>: DATABASE ACCESSION NUMBER: NCBI ACCESSION: NZ_LR134135.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataatgtcgcaagaccaaagaggggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcacaaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtggggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 4985 - DNA, 1546 bp, Lelliottia aquatilis
  ref <308>: DATABASE ACCESSION NUMBER: NCBI ACCESSION: NZ_PQVT01000035.1
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgaggttaataacctcagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagagatgctttagtgccttcgggaaccgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 4986 - DNA, 1554 bp, Lelliottia jeotgali
  ref <308>: DATABASE ACCESSION NUMBER: NCBI ACCESSION: NZ_CP018628.1
  ref <309>: DATABASE ENTRY DATE: 2019-04-01
  ref <313>: RELEVANT RESIDUES IN SEQ ID NO: (1)..(1554)
acttaaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgaggttaataacctcagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagagatgctttagtgccttcgggaaccgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 4987 - DNA, 1550 bp, Lelliottia nimipressuralis
  ref <308>: DATABASE ACCESSION NUMBER: NCBI ACCESSION: NZ_SDDX01000042.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagagatgctttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 4988 - DNA, 1546 bp, Lelliottia sp. 7254-16; identical to SEQ ID NO: 4985
  ref <308>: DATABASE ACCESSION NUMBER: NCBI ACCESSION: NZ_PQVS01000032.1
  ref <309>: DATABASE ENTRY DATE: 2019-04-01
  ref <313>: RELEVANT RESIDUES IN SEQ ID NO: (1)..(1546)

SEQ ID NO: 4989 - DNA, 1550 bp, Lelliottia sp. F153; identical to SEQ ID NO: 4987
  ref <308>: DATABASE ACCESSION NUMBER: NCBI ACCESSION: NZ_PKFT01000005.1
  ref <309>: DATABASE ENTRY DATE: 2019-04-01
  ref <313>: RELEVANT RESIDUES IN SEQ ID NO: (1)..(1550)

SEQ ID NO: 4990 - DNA, 1550 bp, Lelliottia sp. F154; identical to SEQ ID NO: 4987
  ref <308>: DATABASE ACCESSION NUMBER: NCBI ACCESSION: NZ_PKFV01000019.1
  ref <309>: DATABASE ENTRY DATE: 2019-04-01
  ref <313>: RELEVANT RESIDUES IN SEQ ID NO: (1)..(1550)

SEQ ID NO: 4991 - DNA, 1550 bp, Lelliottia sp. F159; identical to SEQ ID NO: 4987
  ref <308>: DATABASE ACCESSION NUMBER: NCBI ACCESSION: NZ_PKFU01000021.1
  ref <309>: DATABASE ENTRY DATE: 2019-04-01
  ref <313>: RELEVANT RESIDUES IN SEQ ID NO: (1)..(1550)

SEQ ID NO: 4992 - DNA, 1550 bp, Lelliottia sp. WB101
  ref <308>: DATABASE ACCESSION NUMBER: NCBI ACCESSION: NZ_CP028520.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgaggttaataacctcagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 4993 - DNA, 1574 bp, Lentibacillus amyloliquefaciens
  ref <308>: DATABASE ACCESSION NUMBER: NCBI ACCESSION: NZ_CP013862.1
  ref <309>: DATABASE ENTRY DATE: 2019-04-01
  ref <313>: RELEVANT RESIDUES IN SEQ ID NO: (1)..(1574)
ttttttggagagtttgatcttggctcaggacgaacgctggcggcgtgcctaatacatgcaagtcgagcgcgggaagcaggcaatcgcccttcggggcgtgcgcttgtggaacgagcggcggacgggtgagtaacacgtgggcaacctgcctgtaagacggggataactcgtggaaacgcgagctaataccggataatgctcatggctgcatggccaggagctgaaagggcggcctttgggtgccgcttacagatgggcccgcggcgcattagttagttggtaaggtaaaagcttaccaaggcgacgatgcgtagccgacctgagagggtgatcggccacactgggactgagacacggcccagactcctacgggaggcagcagtagggaatcatccgcaatggacgaaagtctgacggtgcaacgccgcgtgagtgatgaaggttttcggatcgtaaaactctgttgtcagggaagaacacgtgctgttcgaagagggcagcaccttgacggtacctgaccagaaagccccggctaactacgtgccagcagccgcggtaatacgtagggggcaagcgttgtccggaattattgggcgtaaagcgcgcgcaggcggtcttttaagtctgatgtgaaatcccgcggctcaaccgcgggcggtcattggaaactggaggacttgagtgcagaagaggagagtggaattccacgtgtagcggtgaaatgcgtagagatgtggaggaacaccagtggcgaaggcgactctctggtctgtaactgacgctgaggtgcgaaagcatgggtagcgaacaggattagataccctggtagtccatgccgtaaacgatgagtgctaggtgttagggggtttccaccccttagtgctgaagttaacgcaataagcactccgcctggggagtacggccgcaaggctgaaactcaaaagaattgacgggggcccgcacaagcggtggagcatgtggtttaattcgaagcaacgcgaagaaccttaccaggtcttgacatcctctgatggcggtagagataccgtgttcccttcggggacagagtgacaggtggtgcatggttgtcgtcagctcgtgtcgtgagatgttgggttaagtcccgtaacgagcgcaacccttgatcttagttgccagcattcagttgggcactctaaggtgactgccggtgacaaaccggaggaaggcggggatgacgtcaaatcatcatgccccttatgacctgggctacacacgtgctacaatggatggaacaaagggccgcgaagccgcaaggccaagccaatcccataaaaccattcccagttcggattgcaggctgcaactcgcctgtatgaagccggaatcgctagtaatcgcggatcagcatgccgcggtgaatacgttcccgggccttgtacacaccgcccgtcacaccacgagagttggcaacacccgaagtcggtgaggtaaccttttcaggagccagccgccgaaggtggggccaatgattggggtgaagtcgtaacaaggtagccgtatcggaaggtgcggctggatcacctcctttctaa

SEQ ID NO: 4994 - DNA, 1571 bp, Lentibacillus jeotgali
  ref <308>: DATABASE ACCESSION NUMBER: NCBI ACCESSION: NZ_AGAV01000024.1
  ref <309>: DATABASE ENTRY DATE: 2019-04-01
  ref <313>: RELEVANT RESIDUES IN SEQ ID NO: (1)..(1571)
tttattggagagtttgatcttggctcaggacgaacgctggcggcgtgcctaatacatgcaagtcgagcgcgggaagcaggtaatcgcccttcggggcgagcgcctgtggaacgagcggcggacgggtgagtaacacgtgggcaacctgcctgtaagactgggataactccgggaaaccggggctaataccggataatacacagcatcgcatggcgccgtgttgaaaggcggcttttagctgtcacttacagatgggcccgcggcgcattagttagttggtaaggtcaaagcttaccaaggcgacgatgcgtagccgacctgagagggtgatcggccacactgggactgagacacggcccagactcctacgggaggcagcagtagggaatcatccgcaatggacgaaagtctgacggtgcaacgccgcgtgagtgatgaaggttttcggatcgtaaagctctgttgtcagggaagaacacgtgctgctcgaagagggcagcgccttgacggtacctgaccagaaagccccggctaactacgtgccagcagccgcggtaatacgtagggggcaagcgttgtccggaattattgggcgtaaagcgcacgcaggcggtcttttaagtctgatgtgaaatcccgcggctcaaccgcgggcggtcattggaaactggaggacttgagtgcagaagaggagagtggaattccacgtgtagcggtgaaatgcgtagagatgtggaggaacaccagtggcgaaggcgactctctggtctgtaactgacgctgaggtgcgaaagcatgggtagcgaacaggattagataccctggtagtccatgccgtaaacgttgagtgctaggtgttagggggtttccacccctttgtgctgaagttaacgcattaagcactccgcctggggattacggccgcaaggctgaaactcaaaagaattgacgggggcccgcacaagcggtggagcatgtggtttaattcgaagcaacgcgaagaaccttaccaggtcttgacatcctctgatggcggtagagataccgtgttcccttcggggacagagtgacaggtggtgcatggttgtcgtcagctcgtgtcgtgagatgttgggttaagtcccgtaacgagcgcaacccttgatcttagttgccagcattcagttgggcactctaaggtgactgccggtgacaaaccggaggaaggcggggatgacgtcaaatcatcatgccccttatgacctgggctacacacgtgctacaatggatggaacaaagggcagcgaagccgtgaggtgaagcaaatcccataaaaccattcccagttcggattgcaggctgcaactcgcctgtatgaagccggaatcgctagtaatcgcggatcagaatgccgcggtgaatacgttcccgggccttgtacacaccgcccgtcacaccacgagagttggcaacacccgaagtcggtgaggtaaccttagggagccagccgccgaaggtggggccaatgattggggtgaagtcgtaacaaggtagccgtatcggaaggtgcggctggatcacctcctttctaa

SEQ ID NO: 4995 - DNA, 1526 bp, Lentisphaera araneosa
  ref <308>: DATABASE ACCESSION NUMBER: NCBI ACCESSION: NZ_ABCK01000018.1
  ref <309>: DATABASE ENTRY DATE: 2019-04-01
  ref <313>: RELEVANT RESIDUES IN SEQ ID NO: (1)..(1526)
attgattggagagtttgatcctggctcagaatgaatgctggcggcatggattaggcatgcaagttgaacgagaagttcacttcggtgaatggaaagtggcgaaagggtgagtaacgcgtgaataatctgcccctaagtttggaacaacagttggaaacgactgctaataccggatgtgactatcaagacgcatgttttgatatttaaaggttacgcttagggatgagttcgcgtgccattatgctagttggtaaggtaacggcttaccaaggctatgacggctaggtggtctgagaggacgatcacccacactgggactgagacactgcccagactcctgcgggaggctgcagtcgagaatcttccgcaatgcgcgaaagcgtgacggagcaatgccgcgtgatcgaagacggccttcgggttgtaaagatctgtcaggggggaaaaacgatgatggtacccccagaggaagccacggctaactacgtgccagcagccgcggtaatacgtaggtggcgagcattattcggaattactgggcgtaaagggtccgcaggtggtttactaagtcagatgtgaaatttcagtgcttaacactgaacctgcatttgaaactggtagactagagtatgtgagaggtaagcggaatttgtggtgtagcggtggaatgcgtagatatcacaaggaagaccaaaggcgaaggcagcttactggcacaatactgacactcatggacgaaggctaaggtagcgaaaaggattagatacccttgtagtctttagcagtaaacgttgtacactcgatgttggtctggttagtcggatcagtgtctaagctaacgcgataagtgtaccgcctgggaagtacggtcgcaagactaaaactcaaaggaattgacgggggcccgcacaagcggtggagcatgtggcttaattcgaggcaacgcgaagaaccttacccgggtttgacattgagcgacgttcggtgaaagtcgaattcccttcggggcgcaaaaacaggtgctgcatggctgtcgtcagctcgtgctgtgaagtgttcggttaagtccggcaacgagcgcaacccatatccttacttgctaacaggtaatgctgagaaccttaaggagactgcccgtgttaagcgggaggaaggtgtggacgacgtcaagtcagtatggcccttacacccggggctgcacacgtgctacaatggccggtacaaagggcagcgacatagtgatatggagcgaatccccaaaaccggtctcagtacggattggagtctgcaactcgactccatgaagatggaatcgctagtaaatgggcatcagctacggctcattgaatacgttcccgggccttgtacacaccgcccgtcacatcatgggagctgagttcacccgaagtcgttgcgccaacctgcttgcaggaggcagacgccgaaggtgggcttagtgactgggatgaagtcgtaacaaggtagccgttggggaaccagcggctggatcacctcctttttaagga

SEQ ID NO: 4996 - DNA, 1331 bp, Lentzea terrae
  ref <308>: DATABASE ACCESSION NUMBER: NCBI ACCESSION: NZ_QFWW01000049.1
  ref <309>: DATABASE ENTRY DATE: 2019-04-01
  ref <313>: RELEVANT RESIDUES IN SEQ ID NO: (1)..(1331)
gtggaaagttccggcggtatgggatggacccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcgagcgttgtccggaattattgggcgtaaagagctcgtaggcggtttgtcgcgtcggccgtgaaaacttggggcttaactccaagcttgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacggtgggtgctaggtgtggggggcttccacgccctctgtgccgcagctaacgcattaagcaccccgcctggggagtacggccgcaaggctaaaactcaaaggaattgacgggggcccgcacaagcggcggagcatgtggattaattcgatgcaacgcgaagaaccttacctgggcttgacatggactagaaatcctcagagatgagggctcccttgtggctggttcacaggtggtgcatggctgtcgtcagctcgtgtcgtgagatgttgggttaagtcccgcaacgagcgcaaccctcgttccatgttgccagcgcgtaatggcggggactcatgggagactgccggggtcaactcggaggaaggtggggatgacgtcaagtcatcatgccccttatgtccagggcttcacacatgctacaatggccggtacaaagggctgctaaaccgtgaggtggagcgaatcccataaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagcccgtggctcaacccgcaagggggagagcggtcgaaggtgggactggcgattgggacgaagtcgtaacaaggtagccgtaccggaaggtgcggctggatcacctcctttctaaggagca

SEQ ID NO: 4997 - DNA, 1489 bp, Leptolyngbya sp. BC1307
  ref <308>: DATABASE ACCESSION NUMBER: NCBI ACCESSION: NZ_NRTA01000095.1
  ref <309>: DATABASE ENTRY DATE: 2019-04-01
  ref <313>: RELEVANT RESIDUES IN SEQ ID NO: (1)..(1489)
aaaatggagagtttgatcctggctcaggatgaacgctggcggcgtgcttaacacatgcaagtcgaacgaaccttttcggaggtgagtggcggacgggtgagtaacgcgtgaggatctgcctacaggatggggacaacagcgggaaactgctgctaaaacccgatgtgccgagaggtgaaatatttatagcctgtagatgagctcgcgtctgattagctagttggtggggtaaaggcttaccaaggcgacgatcagtagctggtctgagaggacgatcagccacactgggactgagacacggcccagactcctacgggaggcagcagtggggaattttccgcaatgggcgaaagcctgacggagcaacgccgcgtgagggaggaaggcctgtgggttgtaaacctcttttctcagggaagaagttctgacggtacctgaggaatcagcatcggctaactccgtgccagcagccgcggtaagacggaggatgcaagcgttatccggaattattgggcgtaaagcgtccgtaggcggttcagaaagtctgctgttaaagctcacagctcaactgtgaatcggcagtggaaacttctggactagagagtggtaggggtagagggaattcctagtgtagcggtgaaatgcgtagatattaggaagaacaccagtggcgaaggcgctctactgggccattactgacgctgatggacgaaagctaggggagcgaaagggattagatacccctgtagtcctagctgtaaacgatggacactaggtgttggccgtatcgacccggtcagtatcgaagcaaacgcgttaagtgtcccgcctggggagtacgcacgcaagtgtgaaactcaaaggaattgacgggggcccgcacaagcggtggagtatgtggtttaattcgatgcaacgcgaagaaccttaccagggattgacatcctacgaatcttcttgaaagggaagagtgccttcgggagcgtagagacaggtggtgcatggctgtcgtcagctcgtgtcgtgagatgttgggttaagtcccgcaacgagcgcaaccctcgtccttagttgccatcattaagttgggcactttaaggagactgccggtgacaaaccggaggaaggtggggatgacgtcaagtcatcatgccccttacatcctgggctacacacgtactacaatgcaacggacaaagggcagccaactagcgatagtgcgctaatcccataaaccgttgctcagttcagattgcaggctgcaactcgcctgcatgaaggcggaatcgctagtaatcgcaggtcagcatactgcggtgaatacgttcccgggccttgtacacaccgcccgtcacaccatggaagttggccacgcccgaagtcgttaccccaaccttagggagggggacgccgaaggcagggctgatgactggggtgaagtcgtaacaaggtagccgtaccggaaggtgtggctggatcacctccttag

SEQ ID NO: 4998 - DNA, 1056 bp, Leptolyngbya sp. Heron Island J
  ref <308>: DATABASE ACCESSION NUMBER: NCBI ACCESSION: NZ_AWNH01000013.1
  ref <309>: DATABASE ENTRY DATE: 2019-04-01
  ref <313>: RELEVANT RESIDUES IN SEQ ID NO: (1)..(1056)
atggagagtttgatcctggctcaggatgaacgctggcggcgtgcttaacacatgcaagtcgaacgaacctttcggggttagtggcggacgggtgagtaacgcgtgaggatctgcccttaggcgggggacaacttttggaaacggaagctaataccccatatggcgagagctgaaagatttattgcctgaggatgaactcgcgtctgattagctagttggtggggtaattgcttaccaaggcgacgatcagtagctgttctgagaggaagatcagccacactgggactgagacacggcccagactcctacgggaggcagcagtggggaattttccgcaatgggcgcaagcctgacggagcaacgccgcgtgagggaggaatgtctgtggattgtaaacctcttttctctgggaagaagatctgacggtaccagaggaatcagcatcggctaactccgtgccagcagccgcggtaagacggaggatgcaagcgttatccggaattattgggcgtaaagcgtccgtaggcggttaattaagtcagttgttaaagactgcagctcaactgtgggagagcaactgaaactggttaactagagtatggtaggggtagagggaattcctagtgtagcggtgaaatgcgtagatattaggaagaacaccagtggcgaaggcgctctactgggccaagactgacgctgatggacgaaagctaggggagcgaaagggattagatacccctgtagtcctagctgtaaacgatggatactaggtgttgtgcgtatcgacccgtgcagtaccgaagcaaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatccctcgaatatctaagaaattagatagtgccttcgggaacgaggagacaggtggtgcatggctgtcgtcagctcgtgtcgtgagatgttgggttaagtcccgcaacgagcgcaaccc

SEQ ID NO: 4999 - DNA, 1489 bp, Leptolyngbya sp. KIOST-1
  ref <308>: DATABASE ACCESSION NUMBER: NCBI ACCESSION: NZ_JQFA01000004.1
  ref <309>: DATABASE ENTRY DATE: 2019-04-01
  ref <313>: RELEVANT RESIDUES IN SEQ ID NO: (1)..(1489)
aacatggagagtttgatcctggctcaggatgaacgctggcggcgtgcttaacacatgcaagtcgaacgggatcttcggatctagtggcggacgggtgagtaacgcgtgaggatctgcccttaggatggggacaaccactggaaacggtggctaatacccaatgtgccgagaggtgaaacattaatggcctgaggatgaactcgcgtctgattagctagttggtgaggtaagggctcaccaaggcgacgatcagtagctggtctaagaggatgatcagccacactgggactgagacacggcccagactcctacgggaggcagcagtggggaattttccgcaatgggcgcaagcctgacggagcaacgccgcgtgagggaggaaggccttagggttgtaaacctcttttctctgggaagaagacctgacggtaccagaggaataagcctcggctaactccgtgccagcagccgcggtaagacggaggaggcaagcgttatccggaattattgggcgtaaagcgtccgcaggcggttttttaagtctgttgtcaaaggtcacagctcaactgtggatcggcaatggaaactggggaacttgagtgtggtaggggtagagggaattcccggtgtagcggtgaaatgcgtagatatcgggaagaacaccagtggcgaaggcgctctactgggccacaactgacgctgagggacgaaagctaggggagcgaaagggattagatacccctgtagtcctagctgtaaacgatggatactaggtgttggacgtatcgacccgtgcagtaccgtagctaacgcgttaagtatcccgcctggggagtacgcacgcaagtgtgaaactcaaaggaattgacgggggcccgcacaagcggtggaggatgtggtttaattcgatgcaacgcgaagaaccttaccaaggcttgacatgtcgcgaatctctgagagatcagagagtgccttcgggagcgcgaacacaggtggtgcatggctgtcgtcagctcgtgtcgtgagatgttgggttaagtcccgcaacgagcgcaacccacgtttttagttgccagcattcagttgggcactctaaagagactgccggggacaactcggaggaaggtgtggacgacgtcaagtcatcatgccccttacgtcttgggctacacacgtcctacaatgctacagacagagggcagcgagcgcgcgagtgcaagcaaatcccataaactgtggctcagttcagattgcaggctgcaactcgcctgcatgaaggcggaatcgctagtaatcgccggtcagcatacggcggtgaatacgttcccgggccttgtacacaccgcccgtcacaccatgggagttggccacgcccgaagtcgttactctaaccgttcgcggaggagggcgccgaaggcagggctgatgactggggtgaagtcgtaacaaggtagccgtaccggaaggtgtggctggatcacctcctttt

SEQ ID NO: 5000 - DNA, 1500 bp, Leptolyngbya sp. NIES-2104
  ref <308>: DATABASE ACCESSION NUMBER: NCBI ACCESSION: NZ_BBWW01000001.1
  ref <309>: DATABASE ENTRY DATE: 2019-04-01
  ref <313>: RELEVANT RESIDUES IN SEQ ID NO: (1)..(1500)
ttcaacatggagagtttgatcctggctcaggatgaacgctggcggtatgcttaacacatgcaagtcgaacggaagacttcggtctttagtggcggacgggtgagtaacgcgtgagaacatgcctatcgattggggacaacagttggaaacgactgctaataccgaatgtgccctttggggtgaaagatttatcgtcgatagattggctcgcgtcagattagctagtaggagtggtaacggcacccctaggcgacgatctgtacttggtctgagaggatgaccaggcacactggaactgagacacggtccagactcctacgggaggcagcagtggggaattttccgcaatgggcgcaagcctgacggagcaataccgcgtgagggaggacgctttttggagtgtaaacctcttttattagggaagaaatgatgacggtacctaatgaatcagcatcggctaactccgtgccagcagccgcggtaatacggaggatgcaagcgttatccggaattattgggcgtaaagcgtccgtaggtggcagttcaagtcttttgtcaaagcgtgcggcttaaccgcatacgggcggaggaaactgggctgctagagtgcgataggggttacaggaattcccagtgtagcggtgaaatgcgtagatattgggaagaacaccagcggcgaaagcgtgtgactgggtctgcactgacactgagggacgaaagctaggggagcgaaagggattagatacccctgtagtcctagccgtaaacgatgacaactaggtgtggttcgtatcgacccgagccgtgccgtagccaacgcgttaagttgtccgcctggggagtacgcacgcaagtgtgaaactcaaaggaattgacgggggcccgcacaagcggtggagtatgtggtttaattcgatgcaacgcgaagaaccttaccaaggcttgacatcctcggaatccctgtgaaagtagggagtgccttcgggagccgagagacaggtggtgcatggctgtcgtcagctcgtgtcgtgagatgttgggttaagtcccgcaacgagcgcaacccacgtttttagttgccagcattcagttgggcactctagagagactgccggtgacaaaccggaggaaggtgtggatgacgtcaagtcagcatgccccttacgccttgggctacacacgtactacaatgcgttggacaaagagtcgcaagctagcgatagcaagccaatctcataaaccaacgctcagttcagattgcaggctgcaactcgcctgcatgaaggcggaatcgctagtaatcgcaggtcagcatactgcggtgaatacgttcccgggccttgtacacaccgcccgtcacaccatgggagttggtcacgcccgaagtcgttactctaaccgttcgcggaggaggatgccgaaggtggggctgatgactggggtgaagtcgtaacaaggtagccgtaccggaaggtgtggctggatcacctccttaaaggg

SEQ ID NO: 5001 - DNA, 1494 bp, Leptolyngbya sp. NIES-3755
  ref <308>: DATABASE ACCESSION NUMBER: NCBI ACCESSION: NZ_AP017308.1
  ref <309>: DATABASE ENTRY DATE: 2019-04-01
  ref <313>: RELEVANT RESIDUES IN SEQ ID NO: (1)..(1494)
aatggagagtttgatcctggctcaggatgaacgctggcggtatgcttaacacatgcaagtcgaacggagttctttcgggaacttagtggcggacgggtgagtaacgcgtgagaacgtgcctatcgattggggacaacagttggaaacgactgctaataccgaatgtgcctttcggggtaaaagatttattgtcgatagatcggctcgcgtcagattaggtagttggagtggtaacggcacaccaagcctacgatctgtacttggtctgagaggatgaccaggcacactggaactgagacacggtccagactcctacgggaggcagcagtggggaattttccgcaatgggcgcaagcctgacggagcaataccgcgtgagggaggacgctttttggagtgtaaacctcttttattagggaagaatcgatgacggtacctaatgaatcagcatcggctaactccgtgccagcagccgcggtaatacggaggatgcaagcgttatccggaattattgggcgtaaagcgtccgtaggtggcgaatcaagtctgttgtcaaagcgtgcggcttaaccgcatacgggcgatggaaactggtttgctagagtgcgataggggttacaggaattcccagtgtagcggtgaaatgcgtagatattgggaagaacaccagcggcgaaagcgtgtgactgggtctgcactgacactgagggacgaaagctaggggagcgaaagggattagatacccctgtagtcctagccgtaaacgatgacaactaggtgtggttcgtatcgacccgagccgtgccgtagccaacgcgttaagttgtccgcctggggagtacgcacgcaagtgtgaaactcaaaggaattgacgggggcccgcacaagcggtggagtatgtggtttaattcgatgcaacgcgaagaaccttaccaaggcttgacatcctgcgaacttttctgaaaggagaaggtgccttcgggagcgcagagacaggtggtgcatggctgtcgtcagctcgtgtcgtgagatgttgggttaagtcccgcaacgagcgcaacccacgtttttagttgccatcaggtaaagctgggcactctagagagactgccggtgacaaaccggaggaaggtgtggatgacgtcaagtcagcatgccccttacgccttgggctacacacgtactacaatgcgttggacaaagagcagccagacagcgatgttgagccaatctcataaaccaacgctcagttcagattgcaggctgcaactcgcctgcatgaaggcggaatcgctagtaatcgcaggtcagcatactgcggtgaatacgttcccgggccttgtacacaccgcccgtcacaccatgggagttggtcacgcccgaagtcgttactctaaccgttcgcggaggaggatgccgaaggtggggctgatgactggggtgaagtcgtaacaaggtagccgtaccggaaggtgtggctggatcacctcctta

SEQ ID NO: 5002 - DNA, 1495 bp, Leptolyngbya sp. O-77
  ref <308>: DATABASE ACCESSION NUMBER: NCBI ACCESSION: NZ_AP017367.1
  ref <309>: DATABASE ENTRY DATE: 2019-04-01
  ref <313>: RELEVANT RESIDUES IN SEQ ID NO: (1)..(1495)
tcaactcaacaacatggagagtttgatcctggctcaggatgaacgctggcggtctgcttaacacatgcaagtcgaacggggtgcttcggcacctagtggcggcgggtgagtaacgcgtgagaatctgcccttaggacggggacaacagctggaaacggctgctaatacccgatgtgccgagaggtgaaacatttatggcctgaggatgagctcgcgtctgattagctagttggtggggtaagagcctaccaaggcgacgatcagtagctggtctgagaggatgatcagccacactgggactgagacacggcccagactcctacgggaggcagcagtggggaatattggacaatgggcgcaagcctgatccagcaatgccgcgtgggtgaagaaggccttcgggttgtaaagcccttttgtcgggaagaagctctgacggtacccgaggaatcagcaccggctaactccgtgccagcagccgcggtaatacgaagggtgcaagcgttaatcggaattactgggcgtaaagggcgcgtaggcggttgcctaagtccgttgtgaaagccctgggctcaacctgggaatcgcagtggatactgggtggctggagtacggtagagggtggcggaattcccggtgtagcggtgaaatgcgtagatatcgggaggaacaccagtggcgaaggcggccacctggaccagtactgacgctgaggcgcgaaagcgtggggagcaaacaggattagataccctggtagtccacgccctaaacgatggagactaggtgttgcccgtatcgacccgagtgcgctagctaacgcgttaagtgcaccgcctggggagtacggtcgcaaggttgaaactcaaaggaattgacgggggcccgcacaagcggtggagcatgtggtttaattcgaagcaacgcgcagaaccttaccaggccttgacatgtcgggaaccctgctgaaaggcgggggtgccttcgggagcccgaacacaggtgctgcatggctgtcgtcagctcgtgtcgtgagatgttgggttaagtcccgcaacgagcgcaacccttgtccctagttgccagcacttcgggtgggaactctagggagactgccggtgacaaaccggaggaaggtggggatgacgtcaagtcagcatggcctttatatccggggctacacacacgctacaatggttcgtacaatgggcagcgaagctgagaagcggagccaatcccagaaagccgagcctcagttcagattggagtctgcaactcgactccatgaagtcggaatcgctagtaatcgcagatcagcattgctgcggtgaatacgttcccgggccttgtacacaccgcccgtcacgtcatgggagttggttacgcctgaagtcgggaagctaaccccaggaggctacgccgaaggcagggctgatgactggggtgaagtcgtaacaaggtagccgtaccggaaggtgtggctggatcacctcctttt

SEQ ID NO: 5003 - DNA, 1499 bp, Leptolyngbya sp. PCC 6406
  ref <308>: DATABASE ACCESSION NUMBER: NCBI ACCESSION: NZ_KI913949.1
  ref <309>: DATABASE ENTRY DATE: 2019-04-01
  ref <313>: RELEVANT RESIDUES IN SEQ ID NO: (1)..(1499)
aacatggagagtttgatcctggctcaggatgaacgctggcggcgtgcttaacacatgcaagtcgaacggagtgttttcggacacttagtggcggacgggtgagtaacgcgtgaggatctgcccttaggagggggacaactactggaaacggtagctaataccccgtaggccgagaggtgaaatgatttattgcctagggatgagctcgcgtctgattagctagttggtgaggtaaaggcttaccaaggcgacgatcagtagctggtctgagaggatgatcagccacactgggactgagacacggcccagactcctacgggaggcagcagtggggaattttccgcaatgggcgcaagcctgacggagcaacgccgcgtgagggaggaaggtctgtggattgtaaacctcttttctctgggaagaagacctgacggtaccagaggaataagcatcggctaactccgtgccagcagccgcggtaagacggaggatgcaagcgttatccggaattattgggcgtaaagcgtccgcaggcggctagataagtctgctgttaaatatcacagctcaactgtgagacggcggtggaaactgtatagctagagtacggtaggggtagagggaattcccagtgtagcggtgaaatgcgtagatattgggaagaacaccagtggcgaaggcgctctactgggccgtaactgacgctgagggacgaaagctaggggagcgaaagggattagatacccctgtagtcctagctgtaaacgatggatactaggtgttgcgcgtatcgacccgtgcagtaccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgccgcgaatcccttggaaacgagggagtgccttcgggagcgcggacacaggtggtgcatggctgtcgtcagctcgtgtcgtgagatgttgggttaagtcccgcaacgagcgcaacccacgtctttagttgccatcattaagttgggcactctagagagactgccggggacaactcggaggaaggtgtggatgacgtcaagtcatcatgccccttacgttctgggctacacacgtactacaatgcttcggacaaagggcagccagccagcgatggtgagctaatcccataaaccgaggctcagttcagattgcaggctgcaactcgcctgcatgaaggaggaatcgctagtaatcgcaggtcagcatactgcggtgaatacgttcccgggccttgtacacaccgcccgtcacaccatgggagttggccacgcccgaagtcgttaccctaacctttcgaggaggggggcgccgaaggtggggctgatgactggggtgaagtcgtaacaaggtagccgtaccggaaggtgtggctggatcacctcctttcaagga

SEQ ID NO: 5004 - DNA, 1492 bp, Leptolyngbya sp. PCC 7375
  ref <308>: DATABASE ACCESSION NUMBER: NCBI ACCESSION: NZ_JH993797.1
  ref <309>: DATABASE ENTRY DATE: 2019-04-01
  ref <313>: RELEVANT RESIDUES IN SEQ ID NO: (1)..(1492)
atggagagtttgatcctggctcaggatgaacgctggcggcgtgcttaacacatgcaagtcgaacgaacctttcggggtgagtggcggacgggtgagtaacgcgtgaggatctgcccttaggcgggggacaacttttggaaacggaagctaataccccatatggcgggagctgaaagcttaatgtgcctgaggatgaactcgcgtctgattagctagttggtggggtaagagcttaccaaggcgacgatcagtagctgttctgagaggaagatcagccacactgggactgagacacggcccagactcctacgggaggcagcagtggggaattttccgcaatgggcgcaagcctgacggagcaacgccgcgtgagggaggaatgtctgtggattgtaaacctcttttctctgggaagaagatctgacggtaccagaggaatcagcatcggctaactccgtgccagcagccgcggtaagacggaggatgcaagcgttatccggaattattgggcgtaaagcgtccgtaggcggttaattaagtcagttgttaaagactgcagctcaactgtgggagagcaactgaaactggttaactagagtatggtaggggtagagggaattcctagtgtagcggtgaaatgcgtagatattaggaagaacaccagtggcgaaggcgctctactgggccaagactgacgctgatggacgaaagctaggggagcgaaagggattagatacccctgtagtcctagctgtaaacgatggatactaggtgttgtgcgtatcgacccgtgcagtaccgaagcaaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatccctcgaatatctaagaaattaggtagtgccttcgggagcgaggagacaggtggtgcatggctgtcgtcagctcgtgtcgtgagatgttgggttaagtcccgcaacgagcgcaacccacgtctttagttgccatcattcagttgggcactctggagagactgccggggacaactcggaggaaggtgtggacgacgtcaagtcatcatgccccttacgttctgggctacacacgtactacaatgcaacggacaaagggcagccagctagcgatagtgagctaatcccataaaccgttgctcagttcagattgcaggctgcaactcgcctgcatgaaggaggaatcgctagtaatcgcaggtcagcatactgcggtgaatacgttcccgggccttgtacacaccgcccgtcacaccatggaagttggccatgcccgaagtcgttaccctaaccgttcgcggaggggggtgccgaaggcagggctgatgactggggtgaagtcgtaacaaggtagccgtaccggaaggtgtggctggatcacctcctttaaggga

SEQ ID NO: 5005 - DNA, 1490 bp, Leptolyngbya sp. PCC 7376
  ref <308>: DATABASE ACCESSION NUMBER: NCBI ACCESSION: NC_019683.1
  ref <309>: DATABASE ENTRY DATE: 2019-04-01
  ref <313>: RELEVANT RESIDUES IN SEQ ID NO: (1)..(1490)
aacatggagagtttgatcctggctcaggatgaacgctggcggtatgcctaacacatgcaagtcgaacgaagtcttcggacttagtggcggacgggtgagtaacgcgtgagaatctgccttcaggatggggacaacagttggaaacgactgctaatacccaatatgcctacgggtaaaacttatttggcctgaagatgagctcgcgtctgattagctagttggtggtgtaatagactaccaaggcgacgatcagtagctggtctgagaggatgagcggccacactgggactgagacacggcccagactcctacgggaggcagcagtggggaattttccgcaatgggcgaaagcctgacggagcaataccgcgtgagggaggaaggtttttggattgtaaacctcttttctcagggaagaattttgacggtacctgaggaataagcaccggctaactccgtgccagcagccgcggtaatacggagggtgcaagcgttatccggaattattgggcgtaaagagtccgtaggtggtcatgcaagtctgctgtcaaagcccacagcttaactgtggatcggcggtggaaactgcatgacttgagtacggtaggggtagagggaattcccagtgtagcggtgaaatgcgtagatattgggaagaacaccggtggcgaaagcgctctactggaccgtaactgacactgagggacgaaagccaaggtagcgaaagggattagatacccctgtagtcttggccgtaaacgatggatactaggcgttgtctgtatcgacccggacagtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagatttgacatcccgtgaactttccagagatggattggtgccttcgggaacacggagacaggtggtgcatggctgtcgtcagctcgtgtcgtgagatgttgggttaagtcccgcaacgagcgcaaccctcgtccttagttgccatcattaagttgggcactctagggagactgccggggacgaactcggaggaaggtggggatgacgtcaagtcatcatgccccttacattttgggctacacacgtactacaatggtcgggacaaagggcagcaaccccgcgagggcaagcgaatctcatcaaacccggcctcagttcagattgcaggctgcaactcgcctgcatgaaggaggaatcgctagtaatcgcaggtcagcatactgcggtgaatccgttcccgggccttgtacacaccgcccgtcacaccatggaagctggcaacgcccgaagtcgttactctaaccgttcgcggaggagggcgccgaaggcagtgctagtgactggggtgaagtcgtaacaaggtagccgtaccggaaggtgtggctggatcacctcctttt

SEQ ID NO: 5006 - DNA, 753 bp, Leptolyngbya valderiana
  ref <308>: DATABASE ACCESSION NUMBER: NCBI ACCESSION: NZ_LSYZ01000394.1
  ref <309>: DATABASE ENTRY DATE: 2019-04-01
  ref <313>: RELEVANT RESIDUES IN SEQ ID NO: (1)..(753)
ccctggtagtccacgccgtaaacgatgcacactagatcggaggaggtctgacccttttccggtcgaagcgaaagcgttaagtgtgccgcctggggagtacggtcgcaaggctaaaactcaaaggaattgacgggggctcacacaagcggtggagcatgttgcttaattcgaggcaacgcgaagaaccttacctgggtttgacatgcacggattaactctgtgaaagcagagccacgcccgcaagggtggaacgtgcacaggtgctgcatggctgtcgtcagctcgtgctgtgaagtgtcgggttaagtcccttaacgagcgcaacccctatcgttagttactaacgcgtcatggcgaggactctaacgagactgccggtgtcaaaccggaggaaggtggggatgacgtcaagtcctcatggcccttacgcccagggatgcaaacgtgctacaatggcgtgtacagagcgatgctaacctgcgaaggtatgcaaatcgcaaaaagcacgccccagttcggattgcaggctgcaactcgcctgcatgaagccggaatcgctagtaatcggagatcagctacgctccggtgaatacgttcctgagccttgtacacaccgcccgtcaagtcatggaagccgggagcgcccgaagtcgccacgattcagtggtgcctacggcgagttcggtaactgggactaagtcgtaacaaggtagccgtaggagaacctgcggctggatcacctcctttctaagg

SEQ ID NO: 5007 - DNA, 1511 bp, Leptonema illini
  ref <308>: DATABASE ACCESSION NUMBER: NCBI ACCESSION: NZ_JQDG01000109.1
  ref <309>: DATABASE ENTRY DATE: 2019-04-01
  ref <313>: RELEVANT RESIDUES IN SEQ ID NO: (1)..(1511)
acggagagtttgatcctggctcagaactaacgctggcggcgcgtcttaaacatgcaagtcgagcggcagcacttcgggtggcgagcggcgaacgggtgagtaacacgtaggtaatttgcccacggatgggggataacctttcgaaaggaaggctaataccgcataacaccatggttaccacggtaattatggtcaaagcagcaatgcgtctgtggagaagcctgcgtccgattaggtagttggtgaggtaacggctcaccaagccagcgatcggtagccggcctgagagggtgaacggccacactggaactgggacacggtccagactcctacgggaggcagcagttaagaatcttgcgcaatggaggcaactctgacgcagcgacgccgcgtgtgcgatgaaggccctcgggttgtaaagcacaacaaacagggaagaagaaagtgacggtacctgtctgaagcaccggctaactacgtgccagcagccgcggtaatacgtatggtgcaagcgttgttcggaatcactgggcgtaaagggtgcgcaggcggactgttaagtcgggagtgaaaactgagggctcaaccctcagcctgctttcgaaactggcagtctggagtcccggagaggcaggcggaattcccggtgtagcggtgaaatgcacagatatcgggaggaacaccaatggcgaaggcagcctgctggacggagactgacgctcatgcacgaaagcgtggggatcaaacaggattagataccctggtagtccacgccctaaacgttgtagaccagacgttggaggcatcaaccccttcagtgtcaaaccaaacggattaagtctaccgcctggggactatgctcgcaagagtgaaactcaaaggaattgacgggggcccgcacaagcggtggagcatgtggtttaattcgatgatacgcgaaaaaccttacccgggcttgacatgcatcagacaggcgtagagatacgccctccgcgaggctggtgcacaggtgctgcatggttgtcgtcagctcgtgtcgtgagatgttgggttaagtcccgcaacgagcgcaacccctaccgtgtgttaccatcattaagttggggactcgcacggaactgccggtgataaaccggaggaaggtggggatgacgtcaaatcctcatggcctttatgtccggggctacacacgtgctacaatggtcggtacagaaggaagcgaagtcgtgagatggagcagatccgagaaagccgatctcagttcggattggagtctgcaactcgactccatgaagtcggaatcgctagtaatcgcggatcagcatgccgcggtgaatacgttcccgggccttgtacacaccgcccgtcacaccacccgagttggtagtgcccgaagtggtccggctaaccgcaaggaggcagattatcaaggcaagatcggtgaggggggtgaagtcgtaacaaggtagccgtacgggaacgtgcggctggatcacctcctttataaggag

SEQ ID NO: 5008 - DNA, 1514 bp, Leptospira adleri
  ref <308>: DATABASE ACCESSION NUMBER: NCBI ACCESSION: NZ_NPDU01000149.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcaagcggagtagcaatactcagcggcgaacgggtgagtaacacgtgggtaatcttcctccgagtctgggataactttccgaaagggaagctaatactggatagtcccgagagatcacaaggtttttcgggtaaagattcattgctcggagatgagcccgcgtccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcaataagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatataagtcagatgtgaaaactgggggctcaactctcagcctgcatttgaaactatatgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccagcattcagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgtaaggaagcagactactaaggtgaaactcgtgaagggggtgaagtcgtaacaaggtagccgtatcggaaggtgcggctggatcacctcctttttaaggag

SEQ ID NO: 5009 - DNA, 1515 bp, Leptospira alstonii
  ref <308>: DATABASE ACCESSION NUMBER: NCBI ACCESSION: NZ_CP015217.1
  ref <309>: DATABASE ENTRY DATE: 2019-04-01
  ref <313>: RELEVANT RESIDUES IN SEQ ID NO: (1)..(1515)
cacggagagtttgatcctggctcagaactaacgctggcggcgcgtcttaaacatgcaagtcaagcggagtagcaatactcagcggcgaacgggtgagtaacacgtgggtaatcttcctccgagtctgggataacttttcgaaagggaagctaatactggatagtcccgagaggccacaaggcttttcgggtaaagattcattgctcggagatgagcccgcgtccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcaataagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatataagtcagatgtgaaaactgggggctcaactctcagcctgcatttgaaactatatgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccagcattcagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgtaaggaagcagactactaaggtgaaactcgtaaagggggtgaagtcgtaacaaggtagccgtatcggaaggtgcggctggatcacctcctttttaaggag

SEQ ID NO: 5010 - DNA, 1514 bp, Leptospira barantonii
  ref <308>: DATABASE ACCESSION NUMBER: NCBI ACCESSION: NZ_NPDS01000015.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcaagcggagtagcaatactcagcggcgaacgggtgagtaacacgtgggtaatcttcctccgagtctgggataacttttcgaaaggaaagctaatactggatagtcccgagagatcacaaggtctttcgggtaaagattcattgctcggagatgagcccgcgtccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcaataagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgggggctcaactcccagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagcggaatcatgtagagatacatgagccttcgggccgcttcacaggtgctgcatggttgtcgtcagctcgtgtcgtgagatgttgggttaagtcccgcaacgagcgcaaccctcaccttatgttgccagcattcagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgtaaggaagcagactactaaggtgaaactcgtgaagggggtgaagtcgtaacaaggtagccgtatcggaaggtgcggctggatcacctcctttttaaggag

SEQ ID NO: 5011 - DNA, 1498 bp, Leptospira biflexa
  ref <308>: DATABASE ACCESSION NUMBER: NCBI ACCESSION: NC_010602.1
  ref <309>: DATABASE ENTRY DATE: 2019-04-01
  ref <313>: RELEVANT RESIDUES IN SEQ ID NO: (1)..(1498)
cacggagagtttgatcctggctcagaactaacgctggcggcgcgtcttaaacatgcaagtcaaacgggtagtaataccagtggcgaacgggtgagtaatacatggataacctacctagaagttggggataacacagagaaatttgtgctaataccgaatgtgacggttcctggtagcagggattggttaaagcagcaatgcgcttttagatgggtccatggctgattagctagttggtggggtaaaggctcaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggactaacaagtcaggtgtgaaatcttcgggctcaactcgaaacctgcatttgaaactgttagtctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctaggcttgacatgcacgtgaactatgtagagatacatgggccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaactgcaaagtggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgcaaggagaggcacttctaaggtgaaactcgtgaagagggtgaagtcgtaacaaggtagccgtatcggaaggtgcggctggatcacctccttt

SEQ ID NO: 5012 - DNA, 1516 bp, Leptospira borgpetersenii
  ref <308>: DATABASE ACCESSION NUMBER: NCBI ACCESSION: NZ_CP033440.1
  ref <309>: DATABASE ENTRY DATE: 2019-04-01
  ref <313>: RELEVANT RESIDUES IN SEQ ID NO: (1)..(1516)
acggagagtttgatcctggctcagaactaacgctggcggcgcgtcttaaacatgcaagtcaagcggagtagcaatactcagcggcgaacgggtgagtaacacgtgggtaatcttcctccgagtctgggataactttccgaaaggggagctaatactggatagtcccgagaggtcataggatttttcgggtaaagatttattgctcggagatgagcccgcgcccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaaagcagcgacgccgcgtgaacgaggaaaggtcttcggattgtaaagttcaataagcagggaaaaataagcagcgatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgcgggctcaactcgcagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcattcagttgggcactcgtaaggaactgccggtgacaaaccggaggaaggcggggatgacgtcaaatcctcatggcctttatgtctagggcaacacacgtgctacaatggccggtacaaagagtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgcaaggaagcagactactaaggtgaaactcgtgaagggggtgaagtcgtaacaaggtagccgtatcggaaggtgcggctggatcacctcctttttaaggag

SEQ ID NO: 5013 - DNA, 1498 bp, Leptospira brenneri
  ref <308>: DATABASE ACCESSION NUMBER: NCBI ACCESSION: NZ_NPDQ01000021.1
  ref <309>: DATABASE ENTRY DATE: 2019-04-01
  ref <313>: RELEVANT RESIDUES IN SEQ ID NO: (1)..(1498)
cacggagagtttgatcctggctcagaactaacgctggcggcgcgtcttaaacatgcaagtcaaacgggtagcaataccagtggcgaacgggtgagtaatacatggataacctacctagaagttggggataacacagagaaatttgtgctaataccgaatgtgacggttcctgatagcagggattggttaaagcagcaatgcgcttttagatgggtccatggctgattagctagttggtggggtaaaggcctaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggactaacaagtcaggtgtgaaatcttcgggctcaactcgaaacctgcatttgaaactgttagtctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctaggcttgacatgcacgtgaatcatgtagagatacatgagccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaagcgcaagctggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgtaaggagaggcacttctaaggtgaaactcgtgaagagggtgaagtcgtaacaaggtagccgtatcggaaggtgcggctggatcacctccttt

SEQ ID NO: 5014 - DNA, 1514 bp, Leptospira elllisii
  ref <308>: DATABASE ACCESSION NUMBER: NCBI ACCESSION: NZ_NPEH01000112.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcaagcggagtagcaatactcagcggcgaacgggtgagtaacacgtgggtaatcttcctccgagtctgggataacttttcgaaaggaaagctaatactggatagtcccgagagatcacaagatttttcgggtaaagattcattgctcggagatgagcccgcgtccgattagctagttggtgaggtaaaggctcaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgggggctcaactcccagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcatttagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgtaaggaagcagactactaaggtgaaactcgtgaagggggtgaagtcgtaacaaggtagccgtatcggaaggtgcggctggatcacctcctttttaaggag

SEQ ID NO: 5015 - DNA, 1514 bp, Leptospira haakeii
  ref <308>: DATABASE ACCESSION NUMBER: NCBI ACCESSION: NZ_NPEI01000024.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcgagcggagtagcaatacttagcggcgaacgggtgagtaacacgtgggtaatcttcctccgaatctgggataactttccgaaaggaaagctaataccggatagttctattggatcacaggatttgatagataaaggtttactgttcggagatgagcccgcggccgattagctagttggtgaggtaatggctcaccaaggcgacgatcggtagccggcctgagagggtgtccggccacaatggaactgagacacggtccatactcctacgggaggcagcagttaagaatcttgctcaatgggggcaaccctgaagcagcgacgccgcgtgaacgaagaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacttgtaagtcaggtgtgaaaactgcgggctcaacccgtggcctgcacttgaaactataggtctggagtttgggagaggcaagtggaattccaggtgtagcggtgaaatgcgtagatatctggaggaacaccagtggcgaaggcgacttgctggctcaaaactgacgctgaggcacgaaagcgtgggtagtaaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctgggcttgacatggagtggaatcatatagagatatatgagccttcgggccgcttcacaggtgctgcatggttgtcgtcagctcgtgtcgtgagatgttgggttaagtcccgcaacgagcgcaacccctatcgtatgttgctaccattaagttgggcactcgtacgaaactgccggtgacaaaccggaggaaggcggggatgacgtcaaatcctcatggcctttatgtccagggccacacacgtgctacaatggccgatacagagggttgccaactcgcaagagggagctaatctctaaaagtcggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgttaaccgtaaggagacagactactaaggtgaaactcgtgaagggggtgaagtcgtaacaaggtagccgtatcggaaggtgcggctggatcacctcctttttaaggag

SEQ ID NO: 5016 - DNA, 1498 bp, Leptospira harrisiae
  ref <308>: DATABASE ACCESSION NUMBER: NCBI ACCESSION: NZ_NPDW01000001.1
  ref <309>: DATABASE ENTRY DATE: 2019-04-01
  ref <313>: RELEVANT RESIDUES IN SEQ ID NO: (1)..(1498)
cacggagagtttgatcctggctcagaactaacgctggcggcgcgtcttaaacatgcaagtcaaacgggtagcaataccagtggcgaacgggtgagtaatacatggataacctacctagaagttggggataacacagagaaatttgtgctaataccgaatgtgacggttcctgatagcagggattggttaaagcagcaatgcgcttttagatgggtccatggctgattagctagttggtggggtaaaggcctaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggactaacaagtcaggtgtgaaatcttcgggctcaactcgaaacctgcatttgaaactgttagtctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctaggcttgacatgcacgtgaactatgtagagatacatgggccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaagcgcaagctggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgcaaggggaggcacttctaaggtgaaactcgtgaagagggtgaagtcgtaacaaggtagccgtatcggaaggtgcggctggatcacctccttt

SEQ ID NO: 5017 - DNA, 1514 bp, Leptospira hartskeerlii
  ref <308>: DATABASE ACCESSION NUMBER: NCBI ACCESSION: NZ_NPDN01000022.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcgagcggagtagcaatacttagcggcgaacgggtgagtaacacgtgggtaatcttcctccgaatctgggataactttccgaaaggaaagctaataccggatagttctattggatcacaggatttgatagataaaggtttactgttcggagatgagcccgcggccgattagctagttggtgaggtaatggctcaccaaggcgacgatcggtagccggcctgagagggtgtccggccacaatggaactgagacacggtccatactcctacgggaggcagcagttaagaatcttgctcaatgggggcaaccctgaagcagcgacgccgcgtgaacgaagaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacttgtaagtcaggtgtgaaaactgcgggctcaacccgtggcctgcacttgaaactataggtctggagtttgggagaggcaagtggaattccaggtgtagcggtgaaatgcgtagatatctggaggaacaccagtggcgaaggcgacttgctggctcaaaactgacgctgaggcacgaaagcgtgggtagtaaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctgggcttgacatggagtggaatcatatagagatatatgagccttcgggccgcttcacaggtgctgcatggttgtcgtcagctcgtgtcgtgagatgttgggttaagtcccgcaacgagcgcaacccctatcgtatgttgctaccattcagttgggcactcgtacgaaactgccggtgacaaaccggaggaaggcggggatgacgtcaaatcctcatggcctttatgtccagggccacacacgtgctacaatggccgatacagagggttgccaactcgcaagagggagctaatctctaaaagtcggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgttaaccgtaaggagacagactactaaggtgaaactcgtgaagggggtgaagtcgtaacaaggtagccgtatcggaaggtgcggctggatcacctcctttttaaggag

SEQ ID NO: 5018 - DNA, 1515 bp, Leptospira inadai
  ref <308>: DATABASE ACCESSION NUMBER: NCBI ACCESSION: NZ_MCRM02000008.1
  ref <309>: DATABASE ENTRY DATE: 2019-04-01
  ref <313>: RELEVANT RESIDUES IN SEQ ID NO: (1)..(1515)
cacggagagtttgatcctggctcagaactaacgctggcggcgcgtcttaaacatgcaagtcgagcggggtagcaatacctagcggcgaacgggtgagtaacacgtgggtaatcttcctccgagtctgggataactttccgaaaggaaagctaataccggatagtcctactggatcacaggatctgataggtaaagatttattgcttggagatgagcccgcggccgattagctagttggtgaggtaaaggctcaccaaggcgacgatcggtagccggcctgagagggtgtccggccacaatggaactgagacacggtccatactcctacgggaggcagcagttaagaatcttgctcaatgggggaaaccctgaagcagcgacgccgcgtgaacgaagaaggtcttcggattgtaaagttcattaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggatttgtaagtcaggtgtgaaaactgcgggctcaacccgtggcctgcacttgaaactacaagtctggagtttgggagaggcaagtggaattccaggtgtagcggtgaaatgcgtagatatctggaggaacaccagtggcgaaggcgacttgctggctcaaaactgacgctgaggcacgaaagcgtgggtagtaaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctgggcttgacatggatctgaatcatgtagagatatatgagccttcgggcagattcacaggtgctgcatggttgtcgtcagctcgtgtcgtgagatgttgggttaagtcccgcaacgagcgcaacccctatcgtatgttgctaccattcagttgggcactcgtacgaaactgccggtgacaaaccggaggaaggcggggatgacgtcaaatcctcatggcctttatgtccagggcaacacacgtgctacaatggccgatacagagggtcgccaactcgcaagagggagctaatctctaaaagtcggtcccagttcggattggggtctgcaactcgaccccatgaagtcggaatcgctagtaatcgcggatcagcatgccgcggtgaatacgttcccggaccttgtacacaccgcccgtcacaccacctgagtggggagcacccgaagtggtctttgttaaccgtaaggagacagactactaaggtgaaactcgtaaagggggtgaagtcgtaacaaggtagccgtatcggaaggtgcggctggatcacctcctttttaaggag

SEQ ID NO: 5019 - DNA, 1515 bp, Leptospira interrogans
  ref <308>: DATABASE ACCESSION NUMBER: NCBI ACCESSION: NZ_LT962963.1
  ref <309>: DATABASE ENTRY DATE: 2019-04-01
  ref <313>: RELEVANT RESIDUES IN SEQ ID NO: (1)..(1515)
acggagagtttgatcctggctcagaactaacgctggcggcgcgtcttaaacatgcaagtcaagcggagtagcaatactcagcggcgaacgggtgagtaacacgtgggtaatcttcctctgagtctgggataactttccgaaagggaagctaatactggatggtcccgagagatcataagatttttcgggtaaagatttattgctcggagatgagcccgcgtccgattagctagttggtgaggtaaaggctcaccaaggcgacgatcggtagccggcctgagagggtgttcggccacaatggaactgagacacggtccatactcctacgggaggcagcagttaagaatcttgctcaatgggggaaaccctgaagcagcgacgccgcgtgaacgatgaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgcgggctcaactcgcagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcattcagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaatccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaactgcaaggaagcagactactaaggtgaaactcgtgaaggggggtgaagtcgtaacaaggtagccgtatcggaaggtgcggctggatcacctcctttttaaggag

SEQ ID NO: 5020 - DNA, 1514 bp, Leptospira kmetyi
  ref <308>: DATABASE ACCESSION NUMBER: NCBI ACCESSION: NZ_CP033614.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcaagcggagtagcaatactcagcggcgaacgggtgagtaacacgtgggtaatcttcctccgagtctgggataacttttcgaaaggaaagctaatactggatagtcccgagagatcacaaggtttttcgggtaaagatttattgctcggagatgagcccgcgtccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcaataagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgggggctcaactcccagcctgcacttgaaactatatgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcatttagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgtaaggaagcagactactaaggtgaaactcgtgaagggggtgaagtcgtaacaaggtagccgtatcggaaggtgcggctggatcacctcctttttaaggag

SEQ ID NO: 5021 - DNA, 1498 bp, Leptospira levettii
  ref <308>: DATABASE ACCESSION NUMBER: NCBI ACCESSION: NZ_NPEE01000242.1
  ref <309>: DATABASE ENTRY DATE: 2019-04-01
  ref <313>: RELEVANT RESIDUES IN SEQ ID NO: (1)..(1498)
cacggagagtttgatcctggctcagaactaacgctggcggcgcgtcttaaacatgcaagtcaaacgggtagcaataccagtggcgaacgggtgagtaatacatggataacctacctagaagttggggataacacagagaaatttgtgctaataccgaatgtgacggttcctggtagcagggattggttaaagcagcaatgcgcttttagatgggtccatggctgattagctagttggtggggtaaaggcctaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggactaacaagtcaggtgtgaaatcttcgggctcaactcgaaacctgcatttgaaactgttagtctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctaggcttgacatgcacgtgaatcatgtagagatacatgagccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaagcgcaagctggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgcaaggggaggcacttctaaggtgaaactcgtgaagagggtgaagtcgtaacaaggtagccgtatcggaaggtgcggctggatcacctccttt

SEQ ID NO: 5022 - DNA, 1498 bp, Leptospira macculloughii
  ref <308>: DATABASE ACCESSION NUMBER: NCBI ACCESSION: NZ_NPEK01000266.1
  ref <309>: DATABASE ENTRY DATE: 2019-04-01
  ref <313>: RELEVANT RESIDUES IN SEQ ID NO: (1)..(1498)
cacggagagtttgatcctggctcagaactaacgctggcggcgcgtcttaaacatgcaagtcaaacgggtagcaataccagtggcgaacgggtgagtaatacatggataacctacctagaagttggggataacacagagaaatttgtgctaataccgaatgtgacggttcctggtagcagggattggttaaagcagcaatgcgcttttagatgggtccatggctgattagctagttggtggggtaaaggcctaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggactaacaagtcaggtgtgaaatcttcgggctcaactcgaaacctgcatttgaaactgttagtctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctaggcttgacatgcacgtgaatcatgtagagatacatgagccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaagcgcaagctggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgcaaggagaggcacttctaaggtgaaactcgtgaagagggtgaagtcgtaacaaggtagccgtatcggaaggtgcggctggatcacctccttt

SEQ ID NO: 5023 - DNA, 1514 bp, Leptospira mayottensis
  ref <308>: DATABASE ACCESSION NUMBER: NCBI ACCESSION: NZ_CP030147.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcaagcggagtagcaatactcagcggcgaacgggtgagtaacacgtgggtaatcttcctccgagtctgggataacttttcgaaagggaagctaatactggatagtcccgagagatcacaagatttttcgggtaaagattcattgctcggagatgagcccgcgtccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcaataagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgggggctcaactcccagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcatttagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgtaaggaagcagactactaaggtgaaactcgtgaagggggtgaagtcgtaacaaggtagccgtatcggaaggtgcggctggatcacctcctttttaaggag

SEQ ID NO: 5024 - DNA, 1498 bp, Leptospira meyeri; identical to SEQ ID NO: 5022
  ref <308>: DATABASE ACCESSION NUMBER: NCBI ACCESSION: NZ_NPEJ01000136.1
  ref <309>: DATABASE ENTRY DATE: 2019-04-01
  ref <313>: RELEVANT RESIDUES IN SEQ ID NO: (1)..(1498)

SEQ ID NO: 5025 - DNA, 1514 bp, Leptospira neocaledonica
  ref <308>: DATABASE ACCESSION NUMBER: NCBI ACCESSION: NZ_NPEA01000026.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcgagcggagtagcaatacttagcggcgaacgggtgagtaacacgtgggtaatcttcctccgaatctgggataactttccgaaaggaaagctaataccggatagttctattggatcacaggatttgatagataaaggtttactgttcggagatgagcccgcggccgattagctagttggtgaggtaatggctcaccaaggcgacgatcggtagccggcctgagagggtgtccggccacaatggaactgagacacggtccatactcctacgggaggcagcagttaagaatcttgctcaatgggcgcaagcctgaagcagcgacgccgcgtgaacgaagaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacttataagtcaggtgtgaaaactgcgggctcaacccgtggcctgcacttgaaactataggtctggagtttgggagaggcaagtggaattccaggtgtagcggtgaaatgcgtagatatctggaggaacaccagtggcgaaggcgacttgctggctcaaaactgacgctgaggcacgaaagcgtgggtagtaaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctgggcttgacatggagtggaatcatatagagatatatgagccttcgggccgcttcacaggtgctgcatggttgtcgtcagctcgtgtcgtgagatgttgggttaagtcccgcaacgagcgcaacccctatcgtatgttgctaccattaagttgggcactcgtacgaaactgccggtgacaaaccggaggaaggcggggatgacgtcaaatcctcatggcctttatgtccagggccacacacgtgctacaatggccgatacagagggttgccaactcgcaagagggagctaatctctaaaagtcggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgttaaccgtaaggagacagactactaaggtgaaactcgtgaagggggtgaagtcgtaacaaggtagccgtatcggaaggtgcggctggatcacctcctttttaaggag

SEQ ID NO: 5026 - DNA, 1515 bp, Leptospira noguchii
  ref <308>: DATABASE ACCESSION NUMBER: NCBI ACCESSION: NZ_JQRE01000053.1
  ref <309>: DATABASE ENTRY DATE: 2019-04-01
  ref <313>: RELEVANT RESIDUES IN SEQ ID NO: (1)..(1515)
cacggagagtttgatcctggctcagaactaacgctggcggcgcgtcttaaacatgcaagtcaagcggagtagcaatactcagcggcgaacgggtgagtaacacgtgggtaatcttccttcgagtctgggataactttccgaaagggaagctaatactggatagtcccgagagatcataagatttttcgggtaaagattcattgctcggagatgagcccgcgtccgattagctagttggtaaggtaaaggcttaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcaataagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgggggctcaactcccagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcattcagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgcaaggaagcagactactaaggtgaaactcgtgaagggggtgaagtcgtaacaaggtagccgtatcggaaggtgcggctggatcacctcctttttaaggag

SEQ ID NO: 5027 - DNA, 1514 bp, Leptospira perolatii
  ref <308>: DATABASE ACCESSION NUMBER: NCBI ACCESSION: NZ_NPDZ01000033.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcgagcggggtagcaatacctagcggcgaacgggtgagtaacacgtgggtaatctccctccgagtctgggataaccttccgaaaggaaggctaataccggatagtcttggtggtgcacaagcactgctatgtaaaggtttactgcttggagatgagcccgcggccgattagctagttggtgaggtaacggctcaccaaggcgacgatcggtagccggcctgagagggtgtccggccacaatggaactgagacacggtccatactcctacgggaggcagcagttaagaatcttgctcaatgggggcaaccctgaagcagcgacgccgcgtgaacgaagaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgggggctcaaccctcagcctgcacttgaaactatgtgtctggagtttgggagaggcaagtggaattccaggtgtagcggtgaaatgcgtagatatctggaggaacaccagtggcgaaggcgacttgctggctcaaaactgacgctgaggcacgaaagcgtgggtagtaaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctgggcttgacatggagtggaatcatgtagagatacatgagccttcgggccgcttcacaggtgctgcatggttgtcgtcagctcgtgtcgtgagatgttgggttaagtcccgcaacgagcgcaacccctatcgtatgttgctaccatttagttgggcactcgtacgaaactgccggtgacaaaccggaggaaggcggggatgacgtcaaatcctcatggcctttatgtccagggccacacacgtgctacaatggccggtacaaagggttgccaaagcgcaagctggagctaatctcaaaaaaccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgttaaccgcaaggagacagactactaaggtgaaactcgtgaagggggtgaagtcgtaacaaggtagccgtatcggaaggtgcggctggatcacctcctttttaaggag

SEQ ID NO: 5028 - DNA, 1514 bp, Leptospira saintgironsiae; identical to SEQ ID NO: 5025
  ref <308>: DATABASE ACCESSION NUMBER: NCBI ACCESSION: NZ_NPDR01000026.1
  ref <309>: DATABASE ENTRY DATE: 2019-04-01
  ref <313>: RELEVANT RESIDUES IN SEQ ID NO: (1)..(1514)

SEQ ID NO: 5029 - DNA, 1515 bp, Leptospira sp. AMB6-RJ; identical to SEQ ID NO: 5009
  ref <308>: DATABASE ACCESSION NUMBER: NCBI ACCESSION: NZ_QHCS01000002.1
  ref <309>: DATABASE ENTRY DATE: 2019-04-01
  ref <313>: RELEVANT RESIDUES IN SEQ ID NO: (1)..(1515)

SEQ ID NO: 5030 - DNA, 1514 bp, Leptospira sp. B21
  ref <308>: DATABASE ACCESSION NUMBER: NCBI ACCESSION: NZ_QHCR01000024.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcaagcggagtagcaatactcagcggcgaacgggtgagtaacacgtgggtaatcttcctccgagtctgggataacttttcgaaaggaaagctaatactggatggtcccgagagatcacaagatttttcgggtaaagatttattgctcggagatgagcccgcgtccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgggggctcaactcccagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcatttagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgtaaggaagcagactactaaggtgaaactcgtgaagggggtgaagtcgtaacaaggtagccgtatcggaaggtgcggctggatcacctcctttttaaggag

SEQ ID NO: 5031 - DNA, 1498 bp, Leptospira sp. E18
  ref <308>: DATABASE ACCESSION NUMBER: NCBI ACCESSION: NZ_BFAZ01000021.1
  ref <309>: DATABASE ENTRY DATE: 2019-04-01
  ref <313>: RELEVANT RESIDUES IN SEQ ID NO: (1)..(1498)
cacggagagtttgatcctggctcagaactaacgctggcggcgcgtcttaaacatgcaagtcaaacgggtagcaataccagtggcgaacgggtgagtaatacatggataacctacctagaagttggggataacacagagaaatttgtgctaataccgaatgtgacggttcctggtagcagggattggttaaagcagcaatgcgcttttagatgggtccatggctgattagctagttggtggggtaaaggcctaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggactaacaagtcaggtgtgaaatcttcgggctcaactcgaaacctgcatttgaaactgttagtctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctaggcttgacatgcacgtgaactatgtagagatacatgggccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaagcgcaagctggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgcaaggggaggcacttctaaggtgaaactcgtgaagagggtgaagtcgtaacaaggtagccgtatcggaaggtgcggctggatcacctccttt

SEQ ID NO: 5032 - DNA, 1498 bp, Leptospira sp. E30
  ref <308>: DATABASE ACCESSION NUMBER: NCBI ACCESSION: NZ_BFBA01000021.1
  ref <309>: DATABASE ENTRY DATE: 2019-04-01
  ref <313>: RELEVANT RESIDUES IN SEQ ID NO: (1)..(1498)
cacggagagtttgatcctggctcagaactaacgctggcggcgcgtcttaaacatgcaagtcaaacggctagcaatagcagtggcgaacgggtgagtaatacatggataatctacctaaaagttggggataactcagagaaatttgggctaataccgaatgtgacggtttgacataggtcagattggttaaagcagcaatgcgcttttagatgggtccatggctgattagctagttggtagggtaaaggcctaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggatttgtaagtcaggtgtgaaaccttcgagctcaactcgaagcctgcacttgaaactacaaatctggaatttgggagaggcaagcggaatttctggtgtagcggtgaaatgcgtagatatcagaaggaacaccgatggcgaaggcagcttgctggcctaaaattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctaggcttgacatgcacgtgaatcatgtagagatacatgagccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaagcgcaagctggagctaatctcttaaaaccggtcccagttcagattggagtctgcaactcgactccatgaagtcggaatcgctagtaatcgcggatcagcacgccgcggtgaatacgttcccggaccttgtacacaccgcccgtcacaccatctgagtggggagcacccgaagaggttgtccttaaccgcaaggagaggcacttctaaggtgatactcgtgaagagggtgaagtcgtaacaaggtagccgtatcggaaggtgcggctggatcacctccttt

SEQ ID NO: 5033 - DNA, 1514 bp, Leptospira sp. E8; identical to SEQ ID NO: 5025
  ref <308>: DATABASE ACCESSION NUMBER: NCBI ACCESSION: NZ_BFAY01000017.1
  ref <309>: DATABASE ENTRY DATE: 2019-04-01
  ref <313>: RELEVANT RESIDUES IN SEQ ID NO: (1)..(1514)

SEQ ID NO: 5034 - DNA, 1514 bp, Leptospira sp. F1; identical to SEQ ID NO: 5030
  ref <308>: DATABASE ACCESSION NUMBER: NCBI ACCESSION: NZ_QHCU01000018.1
  ref <309>: DATABASE ENTRY DATE: 2019-04-01
  ref <313>: RELEVANT RESIDUES IN SEQ ID NO: (1)..(1514)

SEQ ID NO: 5035 - DNA, 1514 bp, Leptospira sp. P2653
  ref <308>: DATABASE ACCESSION NUMBER: NCBI ACCESSION: NZ_ANMY01000009.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcaagcggagtagcaatactcagcggcgaacgggtgagtaacacgtgggtaatcttcctccgagtctgggataactttccgaaaggggagctaatactggatggtcccgagaggtcatatgatttttcgggtaaagatttattgctcggagctgagcccgcgcccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcaataagcagggaaaaataagcagcgatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgcgggctcaactcgcagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaattatgtagagatacatgagccttcgggccgcttcacaggtgctgcatggttgtcgtcagctcgtgtcgtgagatgttgggttaagtcccgcaacgagcgcaaccctcaccttatgttgccatcatttagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgtaaggaagcagactactaaggtgaaactcgtgaagggggtgaagtcgtaacaaggtagccgtatcggaaggtgcggctggatcacctcctttttaaggag

SEQ ID NO: 5036 - DNA, 1498 bp, Leptospira sp. YH101
  ref <308>: DATABASE ACCESSION NUMBER: NCBI ACCESSION: NZ_BFBB01000019.1
  ref <309>: DATABASE ENTRY DATE: 2019-04-01
  ref <313>: RELEVANT RESIDUES IN SEQ ID NO: (1)..(1498)
cacggagagtttgatcctggctcagaactaacgctggcggcgcgtcttaaacatgcaagtcaaacgggtagcaataccagtggcgaacgggtgagtaatacatggataacctacctaaaagttggggataacacagagaaatttgtgctaataccgaatgtgacggttcctggtagcagggattggttaaagcagcaatgcgcttttagatgggtccatggctgattagctagttggtggggtaaaggcccaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaacaaatgacggtacctacctaaagcaccggctaactacgtgccagcagccgcggtaatacgtatggtgcaagcgttgttcggaatcattgggcgtaaagggtgtgtaggcggattaacaagtcaggtgtgaaaccttcgggctcaactcgaagcctgcacttgaaactgttaatctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctgggcttgacatgcacgtgaattatgtagagatatataagccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtccagggcaacacacgtgctacaatggccggtacagagggtcgccaatccgtgaggtggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgcaaggggaggcacttctaaggtgaaactcgtgaagagggtgaagtcgtaacaaggtagccgtatcggaaggtgcggctggatcacctccttt

SEQ ID NO: 5037 - DNA, 1515 bp, Leptospira sp. Yale; identical to SEQ ID NO: 5009
  ref <308>: DATABASE ACCESSION NUMBER: NCBI ACCESSION: NZ_QHCT01000027.1
  ref <309>: DATABASE ENTRY DATE: 2019-04-01
  ref <313>: RELEVANT RESIDUES IN SEQ ID NO: (1)..(1515)

SEQ ID NO: 5038 - DNA, 1515 bp, Leptospira sp. ZV016
  ref <308>: DATABASE ACCESSION NUMBER: NCBI ACCESSION: NZ_LSSS01000087.1
  ref <309>: DATABASE ENTRY DATE: 2019-04-01
  ref <313>: RELEVANT RESIDUES IN SEQ ID NO: (1)..(1515)
acggagagtttgatcctggctcagaactaacgctggcggcgcgtcttaaacatgcaagtcaagcggagtagcaatacttaagcggcgaacgggtgagtaacacgtgggtaatcttcctccgagtctgggataacttttcgaaaggaaagctaatactggatggtcccgagagatcacaagatttttcgggtaaagatttattgctcggagatgagcccgcgtccgattagctagttggtgaggtaaaggctcaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgcgggctcaactcgcagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggagtggaatcatgtagagatacatgagccttcgggccgcttcacaggtgctgcatggttgtcgtcagctcgtgtcgtgagatgttgggttaagtcccgcaacgagcgcaaccctcaccttatgttgccatcattcagttgggcactcgtaaggaactgccggtgacaaaccggaggaaggcggggatgacgtcaaatcctcatggcctttatgtctagggcaacacacgtgctacaatggccggtacaaagggtagccaactcgcgagggggagctaatctcaaaaagccggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgccaaccgcaaggaagcagactactaaggtgaaactcgtaaagggggtgaagtcgtaacaaggtagccgtatcggaaggtgcggctggatcacctcctttttaaggag

SEQ ID NO: 5039 - DNA, 1498 bp, Leptospira terpstrae
  ref <308>: DATABASE ACCESSION NUMBER: NCBI ACCESSION: NZ_AOGW02000008.1
  ref <309>: DATABASE ENTRY DATE: 2019-04-01
  ref <313>: RELEVANT RESIDUES IN SEQ ID NO: (1)..(1498)
cacggagagtttgatcctggctcagaactaacgctggcggcgcgtcttaaacatgcaagtcaaacgggtagcaataccagtggcgaacgggtgagtaatacatggataacctacctaaaagttggggataacacagagaaatttgtgctaataccgaatgtgacggttcctggtagcagggattggttaaagcagcaatgcgcttttagatgggtccatggctgattagctagttggtggggtaaaggcccaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggactaacaagtcaggtgtgaaatcttcgggctcaactcgaaacctgcatttgaaactgttagtctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctaggcttgacatgcacgtgaactatgtagagatacatgggccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaactgcaaagtggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgcaaggagaggcacttctaaggtgaaactcgtgaagagggtgaagtcgtaacaaggtagccgtatcggaaggtgcggctggatcacctccttt

SEQ ID NO: 5040 - DNA, 1500 bp, Leptospira vanthielii
  ref <308>: DATABASE ACCESSION NUMBER: NCBI ACCESSION: NZ_AOGY02000072.1
  ref <309>: DATABASE ENTRY DATE: 2019-04-01
  ref <313>: RELEVANT RESIDUES IN SEQ ID NO: (1)..(1500)
cacggagagtttgatcctggctcagaactaacgctggcggcgcgtcttaaacatgcaagtcaaacgggtagcaataccagtggcgaacgggtgagtaatacatggataacctacctagaagttggggataacacagagaaatttgtgctaataccgaatgtgacggttcctgatagcagggattggttaaagcagcaatgcgtcttttagatgggtccatggctgattagctagttggtggggtaaaggctcaccaaggcgacgatcagtagccggcctgagagggtgaacggccacaatggaactgagacacggtccatactcctacgggaggcagcagttaagaatcttacgccacgtaccgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggactaacaagtcaggtgtgaaatcttcgggctcaactcgaaacctgcatttgaaactgttagtctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctaggcttgacatgcacgtgaactatgtagagatacatgggccttcgggcacgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaactgcaaagtggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgcaaggggaggcacttctaaggtgaaactcgtgaagagggtgaagtcgtaacaaggtagccgtatcggaaggtgcggctggatcacctccttt

SEQ ID NO: 5041 - DNA, 1514 bp, Leptospira venezuelensis
  ref <308>: DATABASE ACCESSION NUMBER: NCBI ACCESSION: NZ_NFUP01000017.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcgagcggagtagcaatacttagcggcgaacgggtgagtaacacgtgggtaatcttcctccgaatctgggataactttccgaaaggaaagctaataccggatagttctattggatcacaggatttgatagataaaggtttactgttcggagatgagcccgcggccgattagctagttggtgaggtaatggctcaccaaggcgacgatcggtagccggcctgagagggtgtccggccacaatggaactgagacacggtccatactcctacgggaggcagcagttaagaatcttgctcaatgggggcaaccctgaagcagcgacgccgcgtgaacgaagaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacttgtaagtcaggtgtgaaaactgcgggctcaacccgtggcctgcacttgaaactataggtctggagtttgggagaggcaagtggaattccaggtgtagcggtgaaatgcgtagatatctggaggaacaccagtggcgaaggcgacttgctggctcaaaactgacgctgaggcacgaaagcgtgggtagtaaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctgggcttgacatggagtggaatcatatagagatatatgagccttcgggccgcttcacaggtgctgcatggttgtcgtcagctcgtgtcgtgagatgttgggttaagtcccgcaacgagcgcaacccctatcgtatgttgctaccatttagttgggcactcgtacgaaactgccggtgacaaaccggaggaaggcggggatgacgtcaaatcctcatggcctttatgtccagggccacacacgtgctacaatggccgatacagagggttgccaactcgcaagagggagctaatctctaaaagtcggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgttaaccgtaaggagacagactactaaggtgaaactcgtgaagggggtgaagtcgtaacaaggtagccgtatcggaaggtgcggctggatcacctcctttttaaggag

SEQ ID NO: 5042 - DNA, 966 bp, Leptospira weilii
  ref <308>: DATABASE ACCESSION NUMBER: NCBI ACCESSION: NZ_MSFX01000131.1
  ref <309>: DATABASE ENTRY DATE: 2019-04-01
  ref <313>: RELEVANT RESIDUES IN SEQ ID NO: (1)..(966)
ggagagtttgatcctggctcagaactaacgctggcggcgcgtcttaaacatgcaagtcaagcggagtagcaatactcagcggcgaacgggtgagtaacacgtgggtaatcttcctccgagtctgggataactttccgaaaggggagctaatactggatggtcccgagaggtcatatgatttttcgggtaaagatttattgctcggagctgagcccgcgcccgattagctagttggtgaggtaatggctcaccaaggcgacgatcggtagccggcctgagagggtgttcggccacaatggaactgagacacggtccatactcctacgggaggcagcagttaagaatcttgctcaatggggggaaccctgaagcagcgacgccgcgtgaacgatgaaggtcttcggattgtaaagttcaataagcagggaaaaataagcagcgatgtgatgatggtacctgcctaaagcaccggctaactacgtgccagcagccgcggtaatacgtatggtgcaagcgttgttcggaatcattgggcgtaaagggtgcgtaggcggacatgtaagtcaggtgtgaaaactgcgggctcaactcgcagcctgcacttgaaactatgtgtctggagtttgggagaggcaagtggaattccaggtgtagcggtgaaatgcgtagatatctggaggaacaccagtggcgaaggcgacttgctggcctaaaactgacgctgaggcacgaaagcgtgggtagtgaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaaaaacctcacctaggcttgacatggag

SEQ ID NO: 5043 - DNA, 1500 bp, Leptospira wolbachii
  ref <308>: DATABASE ACCESSION NUMBER: NCBI ACCESSION: NZ_AOGZ02000014.1
  ref <309>: DATABASE ENTRY DATE: 2019-04-01
  ref <313>: RELEVANT RESIDUES IN SEQ ID NO: (1)..(1500)
cacggagagtttgatcctggctcagaactaacgctggcggcgcgtcttaaacatgcaagtcaaacgggtagcaataccagtggcgaacgggtgagtaatacatggataacctacctagaagttggggataacacagagaaatttgtgctaataccgaatgtgacggttcctggtagcagggattggttaaagcagcaatgcgcttttagatgggtccatggctgattagctagttggtggggtaaaggctcaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggactaacaagtcaggtgtgaaatcttcgggctcaactcgaaacctgcatttgaaactgttagtctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctaccagttgttagaggtattaactcctctagtaacgaacctaacggattaagtagaccgcctggggactacgctcgcaagagtgaaactcaaaggaattgacgggggtccgcacaagcgagtctacgcatgtggtttaattcgatgatacgcgaaaaaccttacctaggcttgacatgcacgtgaactatgtagagatacatgggccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaagcgcaagctggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgcaaggagaggcacttctaaggtgaaactcgtgaagagggtgaagtcgtaacaaggtagccgtatcggaaggtgcggctggatcacctccttt

SEQ ID NO: 5044 - DNA, 1514 bp, Leptospira wolffii
  ref <308>: DATABASE ACCESSION NUMBER: NCBI ACCESSION: NZ_NPDT01000002.1
  ref <309>: DATABASE ENTRY DATE: 2019-04-01
  ref <313>: RELEVANT RESIDUES IN SEQ ID NO: (1)..(1514)
acggagagtttgatcctggctcagaactaacgctggcggcgcgtcttaaacatgcaagtcgagcggagtagcaatacttagcggcgaacgggtgagtaacacgtgggtaatcttcctccgaatctgggataactttccgaaaggaaagctaataccggatagttctattggatcacaggatttgatagataaaggtttactgttcggagatgagcccgcggccgattagctagttggtgaggtaatggctcaccaaggcgacgatcggtagccggcctgagagggtgtccggccacaatggaactgagacacggtccatactcctacgggaggcagcagttaagaatcttgctcaatgggggcaaccctgaagcagcgacgccgcgtgaacgaagaaggtcttcggattgtaaagttcagtaagcagggaaaaataagcagcaatgtgatgatggtacctgcctaaagcaccggctaactacgtgccagcagccgcggtaatacgtatggtgcaagcgttgttcggaatcattgggcgtaaagggtgcgtaggcggacttgtaagtcaggtgtgaaaactgcgggctcaacccgtggcctgcacttgaaactacaggtctggagtttgggagaggcaagtggaattccaggtgtagcggtgaaatgcgtagatatctggaggaacaccagtggcgaaggcgacttgctggctcaaaactgacgctgaggcacgaaagcgtgggtagtaaacgggattagataccccggtaatccacgccctaaacgttgtctaccagttgttgggggttttaaccctcagtaacgaacctaacggattaagtagaccgcctggggactatgctcgcaagagtgaaactcaaaggaattgacgggggtccgcacaagcggtggagcatgtggtttaattcgatgatacgcgaagaacctcacctgggcttgacatggagtggaatcatatagagatatatgagccttcgggccgcttcacaggtgctgcatggttgtcgtcagctcgtgtcgtgagatgttgggttaagtcccgcaacgagcgcaacccctatcgtatgttgctaccatttagttgggcactcgtacgaaactgccggtgacaaaccggaggaaggcggggatgacgtcaaatcctcatggcctttatgtccagggccacacacgtgctacaatggccgatacaaagggttgccaaagcgcaagctggagctaatctcaaaaagtcggtcccagttcggattggagtctgcaactcgactccatgaagtcggaatcgctagtaatcgcggatcagcatgccgcggtgaatacgttcccggaccttgtacacaccgcccgtcacaccacctgagtggggagcacccgaagtggtctttgttaaccgtaaggagacagactactaaggtgaaactcgtgaagggggtgaagtcgtaacaaggtagccgtatcggaaggtgcggctggatcacctcctttttaaggag

SEQ ID NO: 5045 - DNA, 1499 bp, Leptospira yanagawae
  ref <308>: DATABASE ACCESSION NUMBER: NCBI ACCESSION: NZ_AOGX02000021.1
  ref <309>: DATABASE ENTRY DATE: 2019-04-01
  ref <313>: RELEVANT RESIDUES IN SEQ ID NO: (1)..(1499)
cacggagagtttgatcctggctcagaactaacgctggcggcgcgtcttaaacatgcaagtcaaacgggtagcaataccagtggcgaacgggtgagtaatacatggataacctacctagaagttggggataacacagagaaatttgtgctaataccgaatgtgacggttcctggtagcagggattggttaaagcagcaatgcgcttttagatgggtccatggctgattagctagttggtggggtaaaggcctaccaaggcgacgatcagtagccggcctgagagggtgaacggccacaatggaactgagacacggtccatactcctacgggaggcagcagttaagaatcttgctcaatgggcgaaagcctgaagcagcgacgccgcgtgaacgatgaaggtcttcggattgtaaagttcagtaagtagggacgaaaaaaatgacggtacctacctaaagcaccggctaactacgtgccagcagccgcggtaatacgtatggtgcaagcgttgttcggaatcattgggcgtaaagggtgtgtaggcggactaacaagtcaggtgtgaaatcttcgggctcaactcgaaacctgcatttgaaactgttagtctggaatctgggagaggcaagtggaatttctggtgtagcggtgaaatgcgtagatatcagaaggaacaccgatggcgaaggcaacttgctggcctaagattgacgctgaaacacgaaagcgtgggtagtgaacgggattagataccccggtaatccacgccctaaacgttgtctagtcagttgttagaggtattaactcctctagtaacgaacctaacggattaagtagaccgcctggggactacgctcgcaagagtgaaactcaaaggaattgacgggggtccgcacaagcggtggagcatgtggtttaattcgatgatacgcgaaaaaccttacctaggcttgacatgcacgtgaatcatgtagagatacatgagccttcgggcgcgtgcacaggtgctgcatggctgtcgtcagctcgtgtcgtgagatgttgggttaagtcccgcaacgagcgcaacccttactttctgttgccatcattcagttgggcactcggaaagaactgccggtgacaaaccggaggaaggcggggatgacgtcaagtcctcatggcctttatgtctagggcaacacacgtgctacaatggccggtacagagggtcgccaaactgcaaagtggagctaatctcttaaaaccggtcccagttcagattggagtctgcaactcgactccatgaagtcggaatcgctagtaatcgcggatcagcatgccgcggtgaatacgttcccggaccttgtacacaccgcccgtcacaccatctgagtggggagcacccgaagaggttgtccttaaccgcaaggagaggcacttctaaggtgaaactcgtgaagagggtgaagtcgtaacaaggtagccgtatcggaaggtgcggctggatcacctccttt

SEQ ID NO: 5046 - DNA, 1527 bp, Leptotrichia buccalis
  ref <308>: DATABASE ACCESSION NUMBER: NCBI ACCESSION: NC_013192.1
  ref <309>: DATABASE ENTRY DATE: 2019-04-01
  ref <313>: RELEVANT RESIDUES IN SEQ ID NO: (1)..(1527)
tatgaaaatatattgaatgaagagtttgatcctggctcaggatgaacgctgacagaatgcttaacacatgcaagtctttggcaaatctgtgcttgcacagcctagccaaggcggacgggtgagtaacgcgtaaagaacttgccctgcagacagggataacagacggaaacgactgataatacctgatataattgccagcacgcatgtgcccggcaatgaaaagtgatgctgcaggagagctttgcgtcctattagcttgttggtgaggtaatggctcaccaaggcgatgataggtagccggcctgagagggtgaacggccacaaggggactgagatacggcccttactcctacgggaggcagcagtggggaatattggacaatgggggcaaccctgatccagcaattctgtgtgcacgaagaaggttttcggattgtaaagtgctttcagcagggaagaagaaagtgacggtacctgcagaagaagcgacggctaaatacgtgccagcagccgcggtaatacgtatgtcgcaagcgttatccggaattattgggcataaagggcatctaggcggccagacaagtctggggtgaaaacttgcggctcaaccgcaagcctgccctggaaactgtttggctagagtgctggagaggtggacggaactgcacgagtagaggtgaaattcgtagatatgtgcaggaatgccgatgatgaagatagttcactggacggtaactgacgctgaagtgcgaaagctgggggagcgaacaggattagataccctggtagtcccagccgtaaacgatgattactgggtgtgggcatgaagagtgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctacgaatgcctgtgagaacaggcagtgccttcgggaacgtagagacaggtggtgcatggctgtcgacagctcgtgtcgtgagatgttgggttaagtcccgcaacgagcgcaacccctatcgctagttgccatcattaagttggggactctagcgagactgcctgcgaagagcaggaggaaggtggggatgacgtcaagtcatcatgccccttatgatctgggctacacacgtgctacaatggccggtacaaagagctgcaaaacggtaacgtttagccaatctttaaagccggtccaagttcggattgaagtctgcaactcgacttcatgaagccggaatcgctagtaatcgcagatcagcaatgctgcggtgaatacgttctcgggtcttgtacacaccgcccgtcacaccacgagagttgtttgcacctgaagccgccggtccaaccgtaaggaggaaggcgtctaaggtgtggatagtgattggggtgaagtcgtaacaaggtatccgtaccggaaggtgcggatggatcacctcctttct

SEQ ID NO: 5047 - DNA, 1521 bp, Leptotrichia goodfellowii
  ref <308>: DATABASE ACCESSION NUMBER: NCBI ACCESSION: NZ_KI911785.1
  ref <309>: DATABASE ENTRY DATE: 2019-04-01
  ref <313>: RELEVANT RESIDUES IN SEQ ID NO: (1)..(1521)
attgaatgaagagtttgatcctggctcaggatgaacgctgacagaatgcttaacacatgcaagtcgatggggaagaattaacttgttaatttggtaaccatggcggacgggtgagtaacgcgtaaagaacttacctttcagactgggataacagagggaaacttctgataagaccggatataattaattgattgcatgagagattaatgaaaagagatgctgaaagagagctttgcgtcctattagctagttggtaaggtaatggcttaccaaggcgatgataggtagccggcctgagagggtggacggccacaaggggactgagatacggcccttactcttacgggaggcagcagtggggaatattggacaatggaggagactctgatccagcaattctgtgtgcacgaagaaggttttcggattgtaaagtgctttcagtggggaagaaggaagtgacggtacccacagaagaagcgacggctaaatacgtgccagcagccgcggtaatacgtatgtcgcgagcgttatccggaattattgggcataaagggcatctaggcggacgatcaagtcaggggtgaaaacttgcggctcaactgtaagcttgcctttgaaactgattgtctagagtattggaaaggtgggcggaactacacgagtagaggtgaaattcgtagatatgtgtaggaatgccgatgatgaagatagctcactggacgataactgacgctgaagtgcgaaagctaggggagcgaacaggattagataccctggtagtcctagctgtaaacgatgatcactgggtgtgggcaggaagactgtctgtgccgaagcaaatgcgataagtgatccgcctggggagtacgaccgcaaggttgaaactcaaaggaattgacggggacccgcacaagcggtggagcatgtggtttaattcgacgcaacgcgaggaaccttaccagatcttgacatcctacgaacatgtatgaggatacatggtgccttcgggaacgtagagacaggtggtgcatggctgtcgacagctcgtgtcgtgagatgttgggttaagtcccgcaacgagcgcaacccttatcgttagttaccatcattaagttggggactctagcgagactgcctgcgaagagcaggaggaaggtggggatgacgtcaagtcatcatgccccttatgatctgggctacacacgtgctacaatgggcagtacaaagaggagcgagatagtgatatggagcgaatcttgaaagctgttctaagttcggattgaagtctgcaactcgacttcatgaagttggaatcgctagtaatcgcaaatcagcaatgttgcggtgaatacgttctcgggtcttgtacacaccgcccgtcacaccacgagagttgtttgcacctgaagttactggtctaacttaggaggaaggtacctaaggtgtgaatagtgattggggtgaagtcgtaacaaggtatccgtaccggaaggtgcggatggatcacctcctttctaagga

SEQ ID NO: 5048 - DNA, 733 bp, Leptotrichia hofstadii
  ref <308>: DATABASE ACCESSION NUMBER: NCBI ACCESSION: NZ_AUAY01000017.1
  ref <309>: DATABASE ENTRY DATE: 2019-04-01
  ref <313>: RELEVANT RESIDUES IN SEQ ID NO: (1)..(733)
aaatatattgaatgaagagtttgatcctggctcaggatgaacgctgacagaatgcttaacacatgcaagtctttggcaaatctgtgcttgcacagcctagccaaggcggacgggtgagtaacgcgtaaagaacttgccctgcagacagggataacagacggaaacgactgacaacacctgatacagttgccggcacgcatgtgcccggcaatgaaaagagatgctgcgggagagctttgcgtcctattagcttgttggcggggtaacggcccaccaaggcgatgataggtagccggcctgagagggtggacggccacaaggggactgagatacggcccttactcctacgggaggcagcagtggggaatattggacaatgggggcaaccctgatccagcaattctgtgtgcacgaggaaggttttcggattgtaaagtgctttcagcagggaagaaggaagtgacggtacctgcagaagaagcgacggctaaatacgtgccagcagccgcggtaatacgtatgtcgcaagcgttatccggaattattgggcataaagggcatctaggcggccaggcaagtctggggtgaaaacttgcggctcaaccgcaagcctgccctggaaactgcctggctagagtgctggagaggtggacggaactgcacgagtagaggtgaaattcgtagatatgtgcaggaatgccgatgatgaagatagttcactggacggcaactg

SEQ ID NO: 5049 - DNA, 1528 bp, Leptotrichia massiliensis
  ref <308>: DATABASE ACCESSION NUMBER: NCBI ACCESSION: NZ_FNVZ01000004.1
  ref <309>: DATABASE ENTRY DATE: 2019-04-01
  ref <313>: RELEVANT RESIDUES IN SEQ ID NO: (1)..(1528)
aaatatattgaatgaagagtttgatcctggctcaggatgaacgctgacagaatgcttaacacatgcaagtctttggcaaatctgtgcttgcacagcctagccaaggcggacgggtgagtaacgcgtaaagaacttgccctgcagatagggataacagacggaaacgactgataacacctgatacaattgccggcacgcatgtgcctggcaatgaaaagagatgctgcaggagagctttgcgtcctattagcttgttggtgaggtaacggctcaccaaggcgatgataggtagccggcctgagagggtgaacggccacaaggggactgagatacggcccttactcctacgggaggcagcagtggggaatattggacaatgggggcaaccctgatccagcaattctgtgtgcacgaagaaggttttcggattgtaaagtgctttcagcagggaagaagaaagtgacggtacctgcagaagaagcgacggctaaatacgtgccagcagccgcggtaatacgtatgtcgcaagcgttatccggaattattgggcataaagggcatctaggcggccagacaagtctggggtgaaaacttgcggctcaaccgcaagcctgccctggaaactgtttggctagagtgctggagaggtggacggaactgcacgagtagaggtgaaattcgtagatatgtgcaggaatgccgatgatgaagatagttcactggacggcaactgacgctgaagtgcgaaagctaggggagcgaacaggattagataccctggtagtcctagctgtaaacgatgattactgggtgtgggcatgaagagtgtccgtgccgaagcaaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctacgaatgcctgtgagaacaggcagtgccttcgggaacgtagagacaggtggtgcatggctgtcgacagctcgtgtcgtgagatgttgggttaagtcccgcaacgagcgcaacccctatcgttagttaccatcattaagttggggactctagcgagactgcctgcgaagagcaggaggaaggtggggatgacgtcaagtcatcatgccccttatgatctgggctacacacgtgctacaatggccggtacagagagctgcaaagcggcaacgccaagcgaatctttaaagccggtccaagttcggattgaagtctgcaactcgacttcatgaagctggaatcgctagtaatcgcagatcagcaatgctgcggtgaatacgttctcgggtcttgtacacaccgcccgtcacaccacgagagttgtttgcacctgaagctgccggtctaaccgcaaggaggaaggcatctaaggtgtggatagtgattggggtgaagtcgtaacaaggtatccgtaccggaaggtgcggatggatcacctcctttctaaggag

SEQ ID NO: 5050 - DNA, 1521 bp, Leptotrichia sp. OH3620 COT-345
  ref <308>: DATABASE ACCESSION NUMBER: NCBI ACCESSION: NZ_RQYW01000022.1
  ref <309>: DATABASE ENTRY DATE: 2019-04-01
  ref <313>: RELEVANT RESIDUES IN SEQ ID NO: (1)..(1521)
attgaatgaagagtttgatcctggctcaggatgaacgctgacagaatgcttaacacatgcaagtcgatggggaagtagtacttgtactatggtaaccatggcggacgggtgagtaacgcgtaaagaacttacctttaggacagggataacagagggaaacttctgataagacttgatataattatgtagttgcatgactgtataatgaaaagggatgcctagagagagctttgcgtcctattagttagttggtgtggtaaaggcataccaaggcgatgataggtagccggcctgagagggtggacggccacaaggggactgagatacggcccttactcttacgggaggcagcagtggggaatattggacaatggaggagactctgatccagcaattctgtgtgcacgaagaaggttttcggattgtaaagtgctttcaacagggaagaagaaagtgacggtacctgtagaagaagcgacggctaaatacgtgccagcagccgcggtaatacgtatgtcgcgagcgttatccggaattattgggcataaagggcatctaggcggcatagcaagtcaggggtgaaaacttgtggctcaaccataagcttgcctttgaaactgtgatgctagagtattggaaaggtgggcggaactacacgagtagaggtgaaattcgtagatatgtgtaggaatgccgatgatgaagatagctcactggacgataactgacgctgaagtgcgaaagctaggggagcgaacaggattagataccctggtagtcctagctgtaaacgatgatcactgggtgtgggcaggaagactgtctgtgccgaagcaaatgcgataagtgatccgcctggggagtacgaccgcaaggttgaaactcaaaggaattgacggggacccgcacaagcggtggagcatgtggtttaattcgacgcaacgcgaggaaccttaccagatcttgacatcctcagaagatagtagaagtactattgtgcctttgggaactgagagacaggtggtgcatggctgtcgacagctcgtgtcgtgagatgttgggttaagtcccgcaacgagcgcaacccttatcgttagttaccatcattaagttggggactctagcgagactgcctgcgaagagcaggaggaaggtggggatgacgtcaagtcatcatgccccttatgatctgggctacacacgtgctacaatgggcagtacaaagaggagcgagatggtgacatggagcaaatcttgaaagctgttctaagttcggattgaagtctgcaactcgacttcatgaagttggaatcgctagtaatcgcaaatcagcaatgttgcggtgaatacgttctcgggtcttgtacacaccgcccgtcacaccacgagagttgtttgcacctgaagttactggtctaaccgtaaggaggaaggtacctaaggtgtgaatagtgattggggtgaagtcgtaacaaggtatccgtaccggaaggtgcggatggatcacctcctttctaagga

SEQ ID NO: 5051 - DNA, 1519 bp, Leptotrichia sp. oral taxon 212
  ref <308>: DATABASE ACCESSION NUMBER: NCBI ACCESSION: NZ_CP012410.1
  ref <309>: DATABASE ENTRY DATE: 2019-04-01
  ref <313>: RELEVANT RESIDUES IN SEQ ID NO: (1)..(1519)
ttgaatgaagagtttgatcctggctcaggatgaacgctgacagaatgcttaacacatgcaagtcgatggggaagtggtgcttgcaccatggtaaccatggcggacgggtgagtaacgcgtaagggacttacctgcaggactgggataacagggggaaactcctgacaagaccggataatgtcatggagctgcatggctttatgatgaaaggagacgcctgcggagagccttgcgtcctattagctagttggtgaggtaagggctcaccaaggcgaagataggtagccggcctgagagggtggacggccacaaggggactgagatacggcccttactcctacgggaggcagcagtggggaatattggacaatgggggcaaccctgatccagcaattctgtgtgcacgaagaaggttttcggattgtaaagtgctttcagcagggaagaaggaagtgacggtacctgcagaagaagcgacggctaaatacgtgccagcagccgcggtaatacgtatgtcgcgagcgttatccggaattattgggcataaagggcatctaggcggcctgacaagtcaggggtgaaaacctgcggctcaaccgcaggcctgcctttgaaactgtgaggctggagtaccggagaggtggacggaactgcacgagtagaggtgaaattcgtagatatgtgcaggaatgccgatgatgaagatagttcactggacggtaactgacgctgaagtgcgaaagccgggggagcaaacaggattagataccctggtagtcccggctgtaaacgatgattactgggtgtgggcaggaagactgtctgtgccgaagcaaatgcgataagtaatccgcctggggagtacggccgcaaggctgaaactcaaaggaattgacggggacccgcacaagcggtggagcatgtggtttaattcgacgcaacgcgaggaaccttaccagatcttgacatcccgcgaatgcccgtgaagacgggcagtgccttcgggaacgcggagacaggtggtgcatggctgtcgacagctcgtgtcgtgagatgttgggttaagtcccgcaacgagcgcaacccctgttgctagttaccatcattaagttggggactctagcaagactgcctgcgaagagcaggaggaaggtggggatgacgtcaagtcatcatgccccttatgatctgggctacacacgtgctacaatgggctgtacagagaggagcgaggcggtgacgcggagcgaatctttaaagcagttcgaagttcggattgaagtctgcaactcgacttcatgaagttggaatcgctagtaatcgcggatcagcaatgccgcggtgaatacgttctcgggtcttgtacacaccgcccgtcacaccacgagagttgtctgcacctgaagttactggtctaacatatgaggaaggtacctaaggtgtggatagtgattggggtgaagtcgtaacaaggtatccgtaccggaaggtgcggatggatcacctcctttctagggag

SEQ ID NO: 5052 - DNA, 1518 bp, Leptotrichia sp. oral taxon 215
  ref <308>: DATABASE ACCESSION NUMBER: NCBI ACCESSION: NZ_KI272869.1
  ref <309>: DATABASE ENTRY DATE: 2019-04-01
  ref <313>: RELEVANT RESIDUES IN SEQ ID NO: (1)..(1518)
tgaatgaagagtttgatcctggctcaggatgaacgctgacagaatgcttaacacatgcaagtcgatggggaagtggtgcttgcaccatggtaaccatggcggacgggtgagtaacgcgtaaggaacttgcctgcgggactgggataacagcaggaaactgctgataataccggataaggtcattaagctgcatagcttagtgatgaaaggagacgcctgcggagagccttgcgtcctattagctagttggaggggtaacggcccaccaaggcgaagataggtagccggcctgagagggtggacggccacaaggggactgagatacggcccttactcctacgggaggcagcagtggggaatattggacaatgggggcaaccctgatccagcaattctgtgtgcacgaagacggttttcggattgtaaagtgctttcagcagggaagaagtaagtgacggtacctgcagaagaagcgacggctaaatacgtgccagcagccgcggtaatacgtatgtcgcgagcgttatccggaattattgggcataaagggcatctaggcggcctttcaagtcaggggtgaaaacctgcggctcaaccgcaggcctgcctttgaaactgataggctggagtaccggagaggtggacggaactgcacgagtagaggtgaaattcgtagatatgtgcaggaatgccgatgatgaagatagttcactggacggtaactgacgctgaagtgcgaaagccgggggagcgaacaggattagataccctggtagtcccggccgtaaacgatgattactgggtgtgggcaggaagactgtctgtgccgaagcgaatgcgataagtaatccgcctggggagtacggccgcaaggctgaaactcaaaggaattgacggggacccgcacaagcggtggagcatgtggtttaattcgacgcaacgcgaggaaccttaccagatcttgacatcccgcgaacgcccatgaggatgggcggtgccttcgggaacgcggagacaggtggtgcatggctgtcgacagctcgtgtcgtgagatgttgggttaagtcccgcaacgagcgcaacccctgttgctagttaccatcattaagttggggactctagcgagactgcctgcgaagagcaggaggaaggtggggatgacgtcaagtcatcatgccccttatgatctgggctacacacgtgctacaatgggctgtacagagaggagcgaggcggtgacgcggagcgaatcttgaaagcagttcgaagttcggattgaagtctgcaactcgacttcatgaagttggaatcgctagtaatcgcggatcagcaatgccgcggtgaatacgttctcgggtcttgtacacaccgcccgtcacaccacgagagttgtctgcacctgaagttactggtctaactttggaggaaggtacctaaggtgtggatagtgattggggtgaagtcgtaacaaggtatccgtaccggaaggtgcggatggatcacctcctttctagggag

SEQ ID NO: 5053 - DNA, 1528 bp, Leptotrichia sp. oral taxon 225
  ref <308>: DATABASE ACCESSION NUMBER: NCBI ACCESSION: NZ_KI272935.1
  ref <309>: DATABASE ENTRY DATE: 2019-04-01
  ref <313>: RELEVANT RESIDUES IN SEQ ID NO: (1)..(1528)
aaatatattgaatgaagagtttgatcctggctcaggatgaacgctgacagaatgcttaacacatgcaagtctttggcaaatctgtgcttgcacagcctagccaaggcggacgggtgagtaacgcgtaaagaacttgccctgcagacagggataacagacggaaacgactgataacacctgatacaattgccggcacgcatgtgcctggcaatgaaaagagatgctgcaggagagctttgcgtcctattagcttgttggtgaggtaacggctcaccaaggcgatgataggtagccggcctgagagggtgaacggccacaaggggactgagatacggcccttactcctacgggaggcagcagtggggaatattggacaatgggggcaaccctgatccagcaattctgtgtgcacgaagaaggttttcggattgtaaagtgctttcagcagggaagaagaaagtgacggtacctgcagaagaagcgacggctaaatacgtgccagcagccgcggtaatacgtatgtcgcaagcgttatccggaattattgggcataaagggcatctaggcggccagacaagtctggggtgaaaacttgcggctcaaccgcaagcctgccctggaaactgtttggctagagtgctggagaggtggacggaactgcacgagtagaggtgaaattcgtagatatgtgcaggaatgccgatgatgaagatagttcactggacggcaactgacgctgaagtgcgaaagctaggggagcgaacaggattagataccctggtagtcctagctgtaaacgatgattactgggtgtgggcatgaagagtgtccgtgccgaagcaaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctacgaatgcctgtgagaacaggcagtgccttcgggaacgtagagacaggtggtgcatggctgtcgacagctcgtgtcgtgagatgttgggttaagtcccgcaacgagcgcaacccctatcgttagttaccatcattaagttggggactctagcgagactgcctgcgaagagcaggaggaaggtggggatgacgtcaagtcatcatgccccttatgatctgggctacacacgtgctacaatggccggtacagagagctgcaaagcggcaacgccaagcgaatctttaaagccggtccaagttcggattgaagtctgcaactcgacttcatgaagctggaatcgctagtaatcgcagatcagcaatgctgcggtgaatacgttctcgggtcttgtacacaccgcccgtcacaccacgagagttgtttgcacctgaagctgccggtctaaccgtaaggaggaaggcatctaaggtgtggatagtgattggggtgaagtcgtaacaaggtatccgtaccggaaggtgcggatggatcacctcctttctaaggag

SEQ ID NO: 5054 - DNA, 1520 bp, Leptotrichia sp. oral taxon 847
  ref <308>: DATABASE ACCESSION NUMBER: NCBI ACCESSION: NZ_CP014231.1
  ref <309>: DATABASE ENTRY DATE: 2019-04-01
  ref <313>: RELEVANT RESIDUES IN SEQ ID NO: (1)..(1520)
ttgaatgaagagtttgatcctggctcaggatgaacgctgacagaatgcttaacacatgcaagtctatggggaaacggtgcttgcaccgcgttaaccatggcggacgggtgagtaacgcgtaaagaacttgccggatggtccgggataacagtcggaaacgactgataataccagatattatgagcctgccgcatagccggctcatgaaaagcaatgccatccgagagctttgcgtcctattagcttgttggtaaggtaacggcttaccaaggctatgataggtagccggcctgagagggtggacggccacaaggggactgagatacggcccttactcctacgggaggcagcagtggggaatattggacaatgggggcaaccctgatccagcaattctgtgtgcacgatgaaggtcttcggatcgtaaagtgctttcagcagggacgaagttctgactgtacctgctaaagaagcgacggctaaatacgtgccagcagccgcggtaatacgtatgtcgcaagcgttatccggaattattgggcataaagggcatctaggcggctttgcaagtccgaggtgaaaactattggctcaaccaatagcttgccttggaaactgctttgctagagtattggagaggtggacggaactgcacgagtagaggtgaaattcgtagatatgtgcaggaatgccgatgatgaagatagttcactggacgataactgacgctcaagtgcgaaagctaggggagcaaacaggattagataccctggtagtcctagctgtaaacgatgattactgggtgtgggcatgaagagtgtccgtgccgaagttaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctcggtaggtgatagtaatatcaccgtgccctcgggaaccgagtgacaggtggtgcatggctgtcgacagctcgtgtcgtgagatgttgggttaagtcccgcaacgagcgcaacccctatcgctagttgccatcattaagttggggactctagcgagactgcctgcgaagagcaggaggaaggtggggatgacgtcaagtcatcatgccccttatgatctgggctacacacgtgctacaatggctggtacagagagacgcaatgcagcaatgcctagctaacctctaaagccagtccaagttcggattgaagtctgcaactcgacttcatgaagttggaatcgctagtaatcgcagatcagcaatgctgcggtgaatacgttctcgggtcttgtacacaccgcccgtcacaccacgagagttgtctgcacctgaagctgccggtctaacctttcggaagaaggcatctaaggtgtgaacagtgattggggtgaagtcgtaacaaggtatccgtaccggaaggtgcggatggatcacctcctttctaaggag

SEQ ID NO: 5055 - DNA, 862 bp, Leptotrichia sp. oral taxon 879
  ref <308>: DATABASE ACCESSION NUMBER: NCBI ACCESSION: NZ_KI271294.1
  ref <309>: DATABASE ENTRY DATE: 2019-04-01
  ref <313>: RELEVANT RESIDUES IN SEQ ID NO: (1)..(862)
attgaatgaagagtttgatcctggctcaggatgaacgctgacagaatgcttaacacatgcaagtctttggcgaagctgtgcttgcacagactagccaaggcggacgggtgagtaacgcgtaaggaacttaccctgcagacagggataacagatggaaacgactgataagacctggtattgtcaggctgacgcatgtcaagcctgatgaaaggagacgctgcaggagagccttgcgtcctattagctagttggtggggtaatggcctaccaaggcgatgataggtagccggcctgagagggtgaacggccacaaggggactgagatacggcccttactcctacgggaggcagcagtggggaatattggacaatgggggcaaccctgatccagcaattctgtgtgcacgaagaaggttttcggattgtaaagtgctttcagcagggaagaagaaagtgacggtacctgcagaagaagcgacggctaaatacgtgccagcagccgcggtaatacgtatgtcgcaagcgttatccggaattattgggcataaagggcatctaggcggccctgtaagtctagggtgaaaacctgcggctcaaccgcaggcttgccccggaaactacagggctagagtaccggagaggtggacggaactgcacgagtagaggtgaaattcgtagatatgtgcaggaatgccgatgatgaagatagttcactggacggcaactgacgctgaagtgcgaaagctaggggagcaaacaggattagataccctggtagtcctagctgtaaacgatgattactgggtgtgggcatgaagagtgtccgtgccgaagcaaatgcgataagtaatccgcctgggga

SEQ ID NO: 5056 - DNA, 366 bp, Leptotrichia trevisanii
  ref <308>: DATABASE ACCESSION NUMBER: NCBI ACCESSION: NZ_AXVL01000005.1
  ref <309>: DATABASE ENTRY DATE: 2019-04-01
  ref <313>: RELEVANT RESIDUES IN SEQ ID NO: (1)..(366)
aaatatattgaatgaagagtttgatcctggctcaggatgaacgctgacagaatgcttaacacatgcaagtctttggcgaatctgtgcttgcacaggctagccaaggcggacgggtgagtaacgcgtaaagaacttgccctgcagacagggataacagacggaaacgactgataacacctgatacaattgccggcacgcatgtgcctggcaatgaaaagagatgctgcaggagagctttgcgtcctattagcttgttggtgaggtaacggctcaccaaggcgatgataggtagccggcctgagagggtgaacggccacaaggggactgagatacggcccttactcctacgggaggcagcagtgggga

SEQ ID NO: 5057 - DNA, 1522 bp, Leptotrichia wadei
  ref <308>: DATABASE ACCESSION NUMBER: NCBI ACCESSION: NZ_KQ960030.1
  ref <309>: DATABASE ENTRY DATE: 2019-04-01
  ref <313>: RELEVANT RESIDUES IN SEQ ID NO: (1)..(1522)
attgaatgaagagtttgatcctggctcaggatgaacgctgacagaatgcttaacacatgcaagtctttggcgaagctgtgcttgcacagcctagccaaggcggacgggtgagtaacgcgtaagggacttgccctgcagtcagggataacagacggaaacgactgataagacctggtaaagtcaggcggactcatgtccagcctgatgaaaaggaatgctgcaggagagccttgcgtcctattagcttgttggtggggtaacggcccaccaaggcgatgataggtagccggcctgggagggtggacggccacaaggggactgagatacggcccttactcctacgggaggcagcagtggggaatattggacaatgggggcaaccctgatccagcaattctgtgtgcacgatgaaggtcttcggattgtaaagtgctttcagcagggaagaaaaaaatgacggtacctgcagaagaagcgacggctaaatacgtgccagcagccgcggtaatacgtatgtcgcgagcgttatccggaattattgggcataaagggcatctaggcggccggataagtctggggtgaaaacttgcggctcaaccgcaagcctgccctggaaactatgcggctagagtactggagaggtggacggaactgcacgagtagaggtgaaattcgtagatatgtgcaggaatgccgatgatgaagatagttcactggacggtaactgacgctgaagtgcgaaagctaggggagcaaacaggattagataccctggtagtcctagctgtaaacgatgattactgggtgtgggcatgaagagtgtccgtgccgaagctaatgcgataagtaatccgcctggggagtacggccgcaaggctgaaactcaaaggaattgacggggacccgcacaagcggtggagcatgtggtttaattcgacgcaacgcgaggaaccttaccagatcttgacatcctgcgaaggcctgcgagagcaggctgtgcctccgggaacgcagagacaggtggtgcatggctgtcgacagctcgtgtcgtgagatgttgggttaagtcccgcaacgagcgcaacccctattgccagttgccatcattaggttggggactctggcgagactgcctgcgaagagcaggaggaaggcggggatgacgtcaagtcatcatgccccttatgatctgggctacacacgtgctacaatggccggcacagagagctgcaaggcggcaacgccaagccaaccttcaaagccggtccaagttcggattgaagcctgcaactcggcttcatgaagctggaatcgctagtaatcgcagatcagcaatgctgcggtgaatacgttctcgggtcttgtacacaccgcccgtcacaccacgagagttgtctgcacctgaagctgccggtccaaccgcaagggggaaagcatctaaggtgtggatagtgattggggtgaagtcgtaacaaggtatccgtaccggaaggtgcggatggatcacctcctttctaaggag

SEQ ID NO: 5058 - DNA, 1532 bp, Leucobacter sp. DSM 101948
  ref <308>: DATABASE ACCESSION NUMBER: NCBI ACCESSION: NZ_CP035037.1
  ref <309>: DATABASE ENTRY DATE: 2019-04-01
  ref <313>: RELEVANT RESIDUES IN SEQ ID NO: (1)..(1532)
tttacggagagtttgatcctggctcaggacgaacgctggcggcgtgcttaacacatgcaagtcgaacgctgaagcccgagcttgctcgggtggatgagtggcgaacgggtgagtaacacgtgagtaacctgcccatgtctctgggataagcgctggaaacggcgtctaatactggatacgagcatccactgcatggtgaggtgttggaaagatttatcggacatggatggactcgcggcctatcagcttgatggtgaggtaatggctcaccatggcgacgacgggtagtcggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttgtcagggaagaagcctttgggtgacggtacctggagaaaaagcaccggctaactacgtgccagcagccgcggtaatacgtagggtgcaagcgttgtccggaattattgggcgtaaagagctcgtaggcggcttgtcgcgtctgctgtgaaaacccgaggctcaacctcgggcctgcagtgggtacgggcaggctagagtgcggtaggggagattggaattcctggtgtagcggtggaatgcgcagatatcaggaggaacaccgatggcgaaggcagatctctgggccgctactgacgctgaggagcgaaagcatggggagcgaacaggattagataccctggtagtccatgccgtaaacgttgggaactagatgtagggcctgttccacgggttctgtgtcgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatacgagaacactgcagagatgcaggactctttggacactcgtatacaggtggtgcatggttgtcgtcagctcgtgtcgtgagatgttcggttaagtccggcaacgagcgcaaccctcgtcctatgttgccagcacgttatggtgggaactcatgggatactgccgtggtcaacacggaggaaggtggggatgacgtcaaatcatcatgccccttatgtcttgggcttcacgcatgctacaatggccgatacaaagggctgcgataccgcgaggtggagcgaatcccaaaaagtcggtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaaccccttgtgggagggagctgtcgaaggtgggactggtgattaggactaagtcgtaacaaggtagccgtaccggaaggtgcggctggatcacctcctttcta

SEQ ID NO: 5059 - DNA, 1531 bp, Leucobacter sp. OH1287
  ref <308>: DATABASE ACCESSION NUMBER: NCBI ACCESSION: NZ_RQYM01000028.1
  ref <309>: DATABASE ENTRY DATE: 2019-04-01
  ref <313>: RELEVANT RESIDUES IN SEQ ID NO: (1)..(1531)
tttacggagagtttgatcctggctcaggacgaacgctggcggcgtgcttaacacatgcaagtcgaacgatgaagctgggtgcttgcacctggtggattagtggcgaacgggtgagtaacacgtgagtaacctgccctctactctgggataagcgctggaaacggtgtctaatactggatacgaccttgaaccgcatggtttcttggtggaaagttttttcggtaggggatggactcgcggcctatcagcttgatggtgaggtaatggctcaccatggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcttttgtgacggtacctacagaaaaagcaccggctaactacgtgccagcagccgcggtaatacgtagggtgcaagcgttgtccggaattattgggcgtaaagagctcgtaggcggtttgtcgcgtctgctgtgaaatcctaaggctcaaccttagacttgcagtgggtacgggcaggcttgagtgcggtaggggagattggaattcctggtgtagcggtggaatgcgcagatatcaggaagaacaccgatggcgaaggcagatctctgggccgctactgacgctgaggagcgaaagcatggggagcgaacaggattagataccctggtagtccatgccgtaaacgttgggaactagatgtagggactgttccacggtttctgtgtcgacgctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatagaagaacactctagagatagaggactctttggacacttctatacaggtggtgcatggttgtcgtcagctcgtgtcgtgagatgttcggttaagtccggcaacgagcgcaaccctcgtcctatgttgccagcacgttatggtggggactcatgggatactgccgtggtcaacacggaggaaggtggggatgacgtcaaatcatcatgccccttatgtcttgggcttcacgcatgctacaatggccggtacaaagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaacccttttgggagggagctgtctaaggtgggactggtgattaggactaagtcgtaacaaggtagccgtaccggaaggtgcggctggatcacctcctttcta

SEQ ID NO: 5060 - DNA, 1521 bp, Leucobacter sp. OH2974 COT-288
  ref <308>: DATABASE ACCESSION NUMBER: NCBI ACCESSION: NZ_RQYU01000008.1
  ref <309>: DATABASE ENTRY DATE: 2019-04-01
  ref <313>: RELEVANT RESIDUES IN SEQ ID NO: (1)..(1521)
tggagagtttgatcctggctcaggacgaacgctggcggcgtgcttaacacatgcaagtcgaacgatgaagcctagcttgctgggtggattagtggcgaacgggtgagtaacacgtgagtaacctgccccttactctgggataagcgctggaaacggcgtctaatactggatattacctttcatcgcatggtgtttggtggaaagatttttcggtttgggatggactcgcggcctatcagcttgatggtgaggtagtggctcaccatggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgtgagtgacggtacctacagaaaaagcaccggctaactacgtgccagcagccgcggtaatacgtagggtgcaagcgttgtccggaattattgggcgtaaagagctcgtaggcggtttgtcgcgtctgctgtgaaatcctaaggctcaaccttagacttgcagtgggtacgggcaggcttgagtgcggtaggggagattggaattcctggtgtagcggtggaatgcgcagatatcaggaggaacaccgatggcgaaggcagatctctgggccgctactgacgctgaggagcgaaagcatggggagcgaacaggattagataccctggtagtccatgccgtaaacgttgggaactagatgtaggggctgttccacggcttctgtgtcgacgctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatggaagaacactctagagatagaggactctttggacactttcatacaggtggtgcatggttgtcgtcagctcgtgtcgtgagatgttcggttaagtccggcaacgagcgcaacccttgtcctatgttgccagcacttcgggtggggactcatgggatactgccgtggttaacacggaggaaggtggggatgacgtcaaatcatcatgccccttatgtcttgggcttcacgcatgctacaatggccggtacaaagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaaccatttttggggggagctgtcgaaggtgggactggtgattaggactaagtcgtaacaaggtagccgtaccggaaggtgcggctggatcacctcctttcta

SEQ ID NO: 5061 - DNA, 1525 bp, Leucobacter sp. PH1c
  ref <308>: DATABASE ACCESSION NUMBER: NCBI ACCESSION: NZ_AYMV01000048.1
  ref <309>: DATABASE ENTRY DATE: 2019-04-01
  ref <313>: RELEVANT RESIDUES IN SEQ ID NO: (1)..(1525)
tttacggagagtttgatcctggctcaggacgaacgctggcggcgtgcttaacacatgcaagtcgaacgatgaagcccagcttgctgggtggaagagtggcgaacgggtgagtaacacgtgagcaacctgcccttcactctgggataagcactggaaacggtgtctaatactggatatgcacaatggccgcatggtctgttgtgggaaagatttatcggtgaaggatgggctcgcggcctatcagcttgttggtgaggtagtggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggcttgtcgcgtctgctgtgaaaacccgaggctcaacctcgggcctgcagtgggtacgggcaggctagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtagggcctgttccacgggttctgtgtcgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatacgagaacgctgtagagatacagaactctttggacactcgtaaacaggtggtgcatggttgtcgtcagctcgtgtcgtgagatgttcggttaagtccggcaacgagcgcaaccctcgtcctatgttgccagcacgttatggtgggaactcatgggatactgccgtggtcaacacggaggaaggtggggatgacgtcaaatcatcatgccccttatgtcttgggcttcacgcatgctacaatggccgatacaaagggctgcgataccgcgaggtggagcgaatcccaaaaagtcggtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaaccttttggagggagccgtcgaaggtgggactggtgattaggactaagtcgtaacaaggtagccgtaccggaaggtgcggctggatcacctcctttcta

SEQ ID NO: 5062 - DNA, 1534 bp, Leucobacter sp. wl10
  ref <308>: DATABASE ACCESSION NUMBER: NCBI ACCESSION: NZ_KZ984022.1
  ref <309>: DATABASE ENTRY DATE: 2019-04-01
  ref <313>: RELEVANT RESIDUES IN SEQ ID NO: (1)..(1534)
tttacggagagtttgatcctggctcaggacgaacgctggcggcgtgcttaacacatgcaagtcgaacgctgaagctccttgcttgcagggggtggatgagtggcgaacgggtgagtaacacgtgagtaacctgccccgaactctgggataagcgctggaaacggtgtctaatactggatatgtcccatcatcgcatggtgtgtgggtggaaagatttatcggttcgggatggactcgcggcctatcagctggatggtggggtaatggctcaccatggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttgtcggggaagaagccgtgaggtgacggtacccggagaaaaagcaccggctaactacgtgccagcagccgcggtaatacgtagggtgcaagcgttgtccggaattattgggcgtaaagagctcgtaggcggcttgtcgcgtctgccgtgaaatcctcaggctcaacctgaggtctgcggtgggtacgggcaggctagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtagggcctgttccacgggttctgtgtcgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataggagaaccccgcagagatgcgggactctttggacacttctatacaggtggtgcatggttgtcgtcagctcgtgtcgtgagatgttcggttaagtccggcaacgagcgcaaccctcgtcctatgttgccagcacgtgatggtgggaactcatgggatactgccgtggtcaacacggaggaaggtggggatgacgtcaaatcatcatgccccttatgtcttgggcttcacgcatgctacaatggccggtacaaagggctgcgataccgcaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaaccccttgtgggagggagtcgtcgaaggtgggactggtgattaggactaagtcgtaacaaggtagccgtaccggaaggtgcggctggatcacctcctttcta

SEQ ID NO: 5063 - DNA, 1530 bp, Leucobacter triazinivorans
  ref <308>: DATABASE ACCESSION NUMBER: NCBI ACCESSION: NZ_CP035806.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgctgaagcttggagcttgctctgggtggatgagtggcgaacgggtgagtaacacgtgagtaacctgccccgaactctgggataagcgctggaaacggcgtctaatactggatatgtcctgtcaccgcatggtgtgcaggtggaaagatttatcggttcgggatggactcgcggcctatcagcttgatggtgaggtaatggctcaccatggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttgtcagggaagaagcgaaagtgacggtacctggagaaaaagcaccggctaactacgtgccagcagccgcggtaatacgtagggtgcaagcgttgtccggaattattgggcgtaaagagctcgtaggcggcttgtcgcgtctgctgtgaaaacccgaggctcaacctcgggcctgcagtgggtacgggcaagctagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtagggcctgttccacgggttctgtgtcgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatgtagaagaacactgcagagatgcaggactctttggacacttctatacaggtggtgcatggttgtcgtcagctcgtgtcgtgagatgttcggttaagtccggcaacgagcgcaaccctcgtcctatgttgccagcgggttatgccgggaactcatgggatactgccgtggtcaacacggaggaaggtggggatgacgtcaaatcatcatgccccttatgtcttgggcttcacgcatgctacaatggccggtacaaagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagctgtcgaaggtgggactggtgattaggactaagtcgtaacaaggtagccgtaccggaaggtgcggctggatcacctcctttcta

SEQ ID NO: 5064 - DNA, 1557 bp, Leuconostoc carnosum
  ref <308>: DATABASE ACCESSION NUMBER: NCBI ACCESSION: NC_018673.1
  ref <309>: DATABASE ENTRY DATE: 2019-04-01
  ref <313>: RELEVANT RESIDUES IN SEQ ID NO: (1)..(1557)
taaattgagagtttgatcctggctcaggatgaacgctggcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaataaaacttagtatcgcatgataccaggttaaaaggcgctacggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaaaagttaaggtagggaatgaccttagcctgacggtaccataccagaaagggacggctaaatacgtgccagcagccgcggtaatacgtatgtcccgagcgttatccggatttattgggcgtaaagcgagcgcagacggttggttaagtctgatgtgaaagcccggagctcaactccggaaaggcattggaaactggtcaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagaaatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgcgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatggaagtttgtaatgcccaaagccggtggcctaaccgtaaggagggaaccgtctaaggcaggacagatgactggggtgaagtcgtaacaaggtagccgtaggagaacctgcggctggatcacctcctttctaagga

SEQ ID NO: 5065 - DNA, 1558 bp, Leuconostoc citreum
  ref <308>: DATABASE ACCESSION NUMBER: NCBI ACCESSION: NZ_CP024929.1
  ref <309>: DATABASE ENTRY DATE: 2019-04-01
  ref <313>: RELEVANT RESIDUES IN SEQ ID NO: (1)..(1558)
ttaaattgagagtttgatcctggctcaggatgaacgctggcggcgtgcctaatacatgcaagtcgaacgcgcagcgagaggtgcttgcacctttcaagcgagtggcgaacgggtgagtaacacgtggataacctgcctcaaggctggggataacatttggaaacagatgctaataccgaataaaacttagtatcgcatgatatcaagttaaaaggcgctacggcgtcacctagagatggatccgcggtgcattagttagttggtggggtaaaggcttaccaagacgatgatgcatagccgagttgagagactgatcggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaaatgctaaaatagggaatgattttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacaggattagataccctggtagtccacaccgtaaacgatgaatactaggtgttaggaggtttccgcctcttagtgccgaagctaacgcattaagtattccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagttgggcactctagcgagactgccggtgacaaaccggaggaaggcggggacgacgtcagatcatcatgccccttatgacctgggctacacacgtgctacaatggcgtatacaacgagttgccaacctgcgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccttcgggagggagccgtctaaggcaggacagatgactggggtgaagtcgtaacaaggtagccgtaggagaacctgcggctggatcacctcctttctaagga

SEQ ID NO: 5066 - DNA, 1576 bp, Leuconostoc fallax
  ref <308>: DATABASE ACCESSION NUMBER: NCBI ACCESSION: NZ_AEIZ01000004.1
  ref <309>: DATABASE ENTRY DATE: 2019-04-01
  ref <313>: RELEVANT RESIDUES IN SEQ ID NO: (1)..(1576)
tttaaaatgagagtttgatcctggctcaggatgaacgctggcggcgtgcctaatacatgcaagtcgaacgctagtcgcggacctgatcacttcggtgagacgtaaagcatatggctagagtggcgaacgggtgagtaacacgtggacaacctgcctctaagcaggggataacatttggaaacagatgctaataccgtataacaacgcatttcgcatgaagtgtgtttaaaaggggcttcggcctcacttagagatggatccgcggtgcattagttagttggtgaggtaaaggcttaccaagacgatgatgcatagccgagttgagagactgatcggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaatagttaatgtaggaaatgatgttaatgtgacggtaccataccagaaagggacggctaaatacgtgccagcagccgcggtaatacgtatgtcccgagcgttatccggatttattgggcgtaaagcgagcgcagacggttcgttaagtctgaagtgaaagcccacagctcaactgtggaatggctttggaaactggcgaacttgagtgcagtagaggcaagtggaactccatgtgtagcggtggaatgcgtagatatatggaagaacaccagtggcgaaggcggcttgctggactgtaactgacgttgaggctcgaaagtgtgggtagcaaacaggattagataccctggtagtccacaccgtaaacgatgagtgctaggtgttaggaggtttccgcctcttagtgccggagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaagatgttagagataatattgttctcttcggagacaaagtgacaggtggtgcatggtcgtcgtcagctcgtgtcgtgagatgttgggttaagtcccgcaacgagcgcaacccttatgtttagttgccagcatttagttgggcactctagacagactgccggtgacaaaccggaggaaggcggggatgacgtcagatcatcatgccccttatgacctgggctacacacgtgctacaatggcgtatacaacgagttgcgaaccggcgacggtaagctaatctcttaaagtacgtctcagttcggattgtagtctgcaactcgactacatgaagtcggaatcgctagtaatcgcggatcagcatgccgcggtgaatacgttcccgggtcttgtacacaccgcccgtcacaccatgagagtttgtaacacccaaagccggtgggctaaccttcgggaggtagccgtctaaggtgggacagatgattagggtgaagtcgtaacaaggtagccgtaggagaacctgcggctggatcacctcctttctaagga

SEQ ID NO: 5067 - DNA, 1559 bp, Leuconostoc garlicum
  ref <308>: DATABASE ACCESSION NUMBER: NCBI ACCESSION: NZ_CP016329.1
  ref <309>: DATABASE ENTRY DATE: 2019-04-01
  ref <313>: RELEVANT RESIDUES IN SEQ ID NO: (1)..(1559)
tttaaattgagagtttgatcctggctcaggatgaacgctggcggcgtgcctaatacatgcaagtcgaacgcgcagcgaaaggtgcttgcacctttcaagcgagtggcgaacgggtgagtaacacgtggataacctgcctcaaggctggggataacatttggaaacagatgctaataccgaataaaacttagtatcgcatgatacaaagttgaaaggcgctacggcgtcacctagagatgggtccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttagggtcgtaaagcactgttgtatgggaagaaatgctagaatagggaatgattctagttcgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacaggattagataccctggtagtccacaccgtaaacgatgaatactaggtgttaggaggtttccgcctcttagtgccgaagctaacgcattaagtattccgcctggggagtacgaccgcaaggttgaaactcaaaggaattgacggggacccgcacaagcggtggagcatgtggtttaattcgaagcaacgcgaagaaccttaccaggtcttgacatcctttgaagcttctagagatagaagtgttctcttcggagacaaagtgacaggtggtgcatggtcgtcgtcagctcgtgtcgtgagatgttgggttaagtcccgcaacgagcgcaacccttattgttagttgccagcattcagttgggcactctagcgagactgccggtgacaaaccggaggaaggcggggacgacgtcagatcatcatgccccttatgacctgggctacacacgtgctacaatggcgtatacaacgagttgccaacccgcgagggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccttatggagggagccgtctaaggcaggacagatgactagggtgaagtcgtaacaaggtagccgtaggagaacctgcggctggatcacctcctttctaagga

SEQ ID NO: 5068 - DNA, 1559 bp, Leuconostoc gelidum
  ref <308>: DATABASE ACCESSION NUMBER: NCBI ACCESSION: NZ_OBMW01000046.1
  ref <309>: DATABASE ENTRY DATE: 2019-04-01
  ref <313>: RELEVANT RESIDUES IN SEQ ID NO: (1)..(1559)
tttaaattgagagtttgatcctggctcaggatgaacgctggcggcgtgcctaatacatgcaagtcgaacgcacagcgaaaggtgcttgcacctttcaagtgagtggcgaacgggtgagtaacacgtggataacctacctcaaggttggggataacatttggaaacagatgctaataccgaataaaacttagtatcgcatgataccaggttaaaaggcgctacggcgtcacctagagatggatccgcggtgcattagttagttggtggggtaaaggcttaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagagtagggaatgactttagtttgacggtaccataccagaaagggacggctaaatacgtgccagcagccgcggtaatacgtatgtcccgagcgttatccggatttattgggcgtaaagcgagcgcagacggttaattaagtctgatgtgaaagcccggagctcaactccggaaaggcattggaaactggttaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgtgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccgtaaggagggaaccgtctaaggcaggacagatgactggggtgaagtcgtaacaaggtagccgtaggagaacctgcggctggatcacctcctttctaagga

SEQ ID NO: 5069 - DNA, 1558 bp, Leuconostoc inhae
  ref <308>: DATABASE ACCESSION NUMBER: NCBI ACCESSION: NZ_AEMJ01000011.1
  ref <309>: DATABASE ENTRY DATE: 2019-04-01
  ref <313>: RELEVANT RESIDUES IN SEQ ID NO: (1)..(1558)
ttaaattgagagtttgatcctggctcaggatgaacgctggcggcgtgcctaatacatgcaagtcgaacgcacagcgaaaggtgcttgcacctttcaagtgagtggcgaacgggtgagtaacacgtggataacctacctcaaggttggggataacatttggaaacagatgctaataccgaataaaacttagtatcgcatgataccaggttaaaaggcgctacggcgtcacctagagatggatccgcggtgcattagttagttggtggggtaaaggcttaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagagtagggaatgactttagtttgacggtaccataccagaaagggacggctaaatacgtgccagcagccgcggtaatacgtatgtcccgagcgttatccggatttattgggcgtaaagcgagcgcagacggttaattaagtctgatgtgaaagcccggagctcaactccggaaaggcattggaaactggttaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgtgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccgtaaggagggaaccgtctaaggcaggacagatgactggggtgaagtcgtaacaaggtagccgtaggagaacctgcggctggatcacctcctttctaagga

SEQ ID NO: 5070 - DNA, 1559 bp, Leuconostoc kimchii
  ref <308>: DATABASE ACCESSION NUMBER: NCBI ACCESSION: NC_014136.1
  ref <309>: DATABASE ENTRY DATE: 2019-04-01
  ref <313>: RELEVANT RESIDUES IN SEQ ID NO: (1)..(1559)
tttaaattgagagtttgatcctggctcaggatgaacgctggcggcgtgcctaatacatgcaagtcgaacgcgcagcgagaggtgcttgcacctttcaagcgagtggcgaacgggtgagtaacacgtggataacctgcctcaaggctggggataacatttggaaacagatgctaataccgaataaaacttagtatcgcatgatataaagttaaaaggcgctacggcgtcacctagagatggatccgcggtgcattagttagttggtgaggtaaaggctcaccaagacaatgatgcatagccgagttgagagactgatcggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaacagctagaatagggaatgattttagtgtgacggtaccataccagaaagggacggctaaatacgtgccagcagccgcggtaatacgtatgtcccgagcgttatccggatttattgggcgtaaagcgagcgcagacggttgtttaagtctgatgtgaaagcccggagctcaactccggaaaggcattggaaactggacaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgcgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccgtaaggagggaaccgtctaaggcaggacagatgactggggtgaagtcgtaacaaggtagccgtaggagaacctgcggctggatcacctcctttctaagga

SEQ ID NO: 5071 - DNA, 1558 bp, Leuconostoc lactis
  ref <308>: DATABASE ACCESSION NUMBER: NCBI ACCESSION: NZ_RCYK01000033.1
  ref <309>: DATABASE ENTRY DATE: 2019-04-01
  ref <313>: RELEVANT RESIDUES IN SEQ ID NO: (1)..(1558)
ttaaattgagagtttgatcctggctcaggatgaacgctggcggcgtgcctaatacatgcaagtcgaacgcgcagcgaaaggtgcttgcacctttcaagcgagtggcgaacgggtgagtaacacgtggataacctgcctcaaggctggggataacatttggaaacagatgctaataccgaataaaacttagtatcgcatgatacaaagttgaaaggcgctacggcgtcacctagagatgggtccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttagggtcgtaaagcactgttgtatgggaagaaatgctagaatagggaatgattctagttcgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacaggattagataccctggtagtccacaccgtaaacgatgaatactaggtgttaggaggtttccgcctcttagtgccgaagctaacgcattaagtattccgcctggggagtacgaccgcaaggttgaaactcaaaggaattgacggggacccgcacaagcggtggagcatgtggtttaattcgaagcaacgcgaagaaccttaccaggtcttgacatcctttgaagcttctagagatagaagtgttctcttcggagacaaagtgacaggtggtgcatggtcgtcgtcagctcgtgtcgtgagatgttgggttaagtcccgcaacgagcgcaacccttattgttagttgccagcattcagttgggcactctagcgagactgccggtgacaaaccggaggaaggcggggacgacgtcagatcatcatgccccttatgacctgggctacacacgtgctacaatggcgtatacaacgagttgccaacccgcgagggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccttatggagggagccgtctaaggcaggacagatgactagggtgaagtcgtaacaaggtagccgtaggagaacctgcggctggatcacctcctttctaagga

SEQ ID NO: 5072 - DNA, 1557 bp, Leuconostoc mesenteroides
  ref <308>: DATABASE ACCESSION NUMBER: NCBI ACCESSION: NZ_UGPC01000001.1
  ref <309>: DATABASE ENTRY DATE: 2019-04-01
  ref <313>: RELEVANT RESIDUES IN SEQ ID NO: (1)..(1557)
aaattgagagtttgatcctggctcaggatgaacgctggcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaataaaacttagtgtcgcatgacacaaagttaaaaggcgcttcggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaataggaaatgattttagtttgacggtaccataccagaaagggacggctaaatacgtgccagcagccgcggtaatacgtatgtcccgagcgttatccggatttattgggcgtaaagcgagcgcagacggtttattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacccgcgagggtgagctaatctcttaaagtacgtctcagttcggattgtagtctgcaactcgactacatgaagtcggaatcgctagtaatcgcggatcagcacgccgcggtgaatacgttcccgggtcttgtacacaccgcccgtcacaccatgggagtttgtaatgcccaaagccggtggcctaaccttttaggaaggagccgtctaaggcaggacagatgactggggtgaagtcgtaacaaggtagccgtaggagaacctgcggctggatcacctcctttctaagga

SEQ ID NO: 5073 - DNA, 1557 bp, Leuconostoc pseudomesenteroides
  ref <308>: DATABASE ACCESSION NUMBER: NCBI ACCESSION: NZ_QMJJ01000032.1
  ref <309>: DATABASE ENTRY DATE: 2019-04-01
  ref <313>: RELEVANT RESIDUES IN SEQ ID NO: (1)..(1557)
aaattgagagtttgatcctggctcaggatgaacgctggcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaatgaaacttagtgtcgcatgatacgaagttaaaaggcgctttggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaatagggaatgattttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacccgcgagggtgagctaatctcttaaagtacgtctcagttcggattgtagtctgcaactcgactacatgaagtcggaatcgctagtaatcgcggatcagcacgccgcggtgaatacgttcccgggtcttgtacacaccgcccgtcacaccatgggagtttgtaatgcccaaagccggtggcctaaccttttaggaaggagccgtctaaggcaggacagatgactggggtgaagtcgtaacaaggtagccgtaggagaacctgcggctggatcacctcctttctaagga

SEQ ID NO: 5074 - DNA, 1560 bp, Leuconostoc sp. BM2
  ref <308>: DATABASE ACCESSION NUMBER: NCBI ACCESSION: NZ_MOWQ01000060.1
  ref <309>: DATABASE ENTRY DATE: 2019-04-01
  ref <313>: RELEVANT RESIDUES IN SEQ ID NO: (1)..(1560)
ttcaaattgagagtttgatcctggctcaggatgaacgctggcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaatgaaacttagtgtcgcatgatacgaagttaaaaggcgctttggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaatagggaatgattttagtttgacggtaccataccagaaagggacggctaaatacgtgccagcagccgcggtaatacgtatgtcccgagcgttatccggatttattgggcgtaaagcgagcgcagacggttgattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaagccggaggaaggcggggacgacgtcagatcatcatgccccttatgacctgggctacacacgtgctacaatggcgtatacaacgagttgccaacccgcgagggtgagctaatctcttaaagtacgtctcagttcggattgtagtctgcaactcgactacatgaagtcggaatcgctagtaatcgcggatcagcacgccgcggtgaatacgttcccgggtcttgtacacaccgcccgtcacaccatgggagtttgtaatgcccaaagccggtggcctaaccttttaggaaggagccgtctaaggcaggacagatgactggggtgaagtcgtaacaaggtagccgtaggagaacctgcggctggatcacctcctttctaagga

SEQ ID NO: 5075 - DNA, 1559 bp, Leuconostoc sp. C2
  ref <308>: DATABASE ACCESSION NUMBER: NCBI ACCESSION: NC_015734.1
  ref <309>: DATABASE ENTRY DATE: 2019-04-01
  ref <313>: RELEVANT RESIDUES IN SEQ ID NO: (1)..(1559)
tttaaattgagagtttgatcctggctcaggatgaacgctggcggcgtgcctaatacatgcaagtcgaacgcacagcgataggtgcttgcacctatcaagtgagtggcgaacgggtgagtaacacgtggacaacctgcctcaaggctggggataacatttggaaacagatgctaataccgaataaaacttagtgtcgcatgacaccaggttaaaaggcgctacggcgtcacctagagatggatccgcggtgcattagttagttggtgaggtaaaggctcaccaagacaatgatgcatagccgagttgagagactgatcggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaacagctaggatagggaatgattttagtgtgacggtaccataccagaaagggacggctaaatacgtgccagcagccgcggtaatacgtatgtcccgagcgttatccggatttattgggcgtaaagcgagcgcagacggttgtttaagtctgatgtgaaagcccggagctcaactccggaaaggcattggaaactggacaacttgagtgcagtagaggtaagtggaactccatgtgtagcggtggaatgcgtagatatatggaagaacaccagcggcgaaggcggcttactggactgtaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtggcaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccaacctgcgaaggtgagctaatctcttaaagtacgtctcagttcggactgcagtctgcaactcgactgcacgaagtcggaatcgctagtaatcgcggatcagcacgccgcggtgaatacgttcccgggtcttgtacacaccgcccgtcacaccatgggagtttgtaatgcccaaagccggtggcctaaccgtaaggagggaaccgtctaaggcaggacagatgactggggtgaagtcgtaacaaggtagccgtaggagaacctgcggctggatcacctcctttctaagga

SEQ ID NO: 5076 - DNA, 1557 bp, Leuconostoc suionicum
  ref <308>: DATABASE ACCESSION NUMBER: NCBI ACCESSION: NZ_OKQU01000010.1
  ref <309>: DATABASE ENTRY DATE: 2019-04-01
  ref <313>: RELEVANT RESIDUES IN SEQ ID NO: (1)..(1557)
aaattgagagtttgatcctggctcaggatgaacgctggcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaataaaacttagtgtcgcatgacacaaagttaaaaggcgcttcggcgtcacctagagatggatccgcggtgcattagttagttggtggggtaaaggcctaccaagacaatgatgcatagccgagttgagagactgatcggccacattgggactgagacacggcccaaactcctacgggaggctgcagtagggaatcttccacaatgggcgaaagcctgatggagcaacgccgcgtgtgtgatgaaggctttcgggtcgtaaagcactgttgtatgggaagaacagctagaataggaaatgattttagtttgacggtaccataccagaaagggacggctaaatacgtgccagcagccgcggtaatacgtatgtcccgagcgttatccggatttattgggcgtaaagcgagcgcagacggtttattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgcaactgacgttgaggctcgaaagtgtgggtagcaaacaggattagataccctggtagtccacaccgtaaacgatgaacactaggtgttaggaggtttccgcctcttagtgccgaagctaacgcattaagtgttccgcctggggagtacgaccgcaaggttgaaactcaaaggaattgacggggacccgcacaagcggtggagcatgtggtttaattcgaagcaacgcgaagaaccttaccaggtcttgacatcctttgaagcttttagagatagaagtgttctcttcggagacaaagtgacaggtggtgcatggtcgtcgtcagctcgtgtcgtgagatgttgggttaagtcccgcaacgagcgcaacccttattgttagttgccagcattcagatgggcactctagcgagactgccggtgacaaaccggaggaaggcggggacgacgtcagatcatcatgccccttatgacctgggctacacacgtgctacaatggcgtatacaacgagttgccagcccgcgagggtgagctaatctcttaaagtacgtctcagttcggattgtagtctgcaactcgactacatgaagtcggaatcgctagtaatcgcggatcagcacgccgcggtgaatacgttcccgggtcttgtacacaccgcccgtcacaccatgggagtttgtaatgcccaaagccggtggcctaaccttttaggaaggagccgtctaaggcaggacagatgactggggtgaagtcgtaacaaggtagccgtaggagaacctgcggctggatcacctcctttctaagga

SEQ ID NO: 5077 - DNA, 1560 bp, Leuconostocaceae bacterium R-53105
  ref <308>: DATABASE ACCESSION NUMBER: NCBI ACCESSION: NZ_FMYJ01000024.1
  ref <309>: DATABASE ENTRY DATE: 2019-04-01
  ref <313>: RELEVANT RESIDUES IN SEQ ID NO: (1)..(1560)
tttaacatgagagtttgatcctggctcaggatgaacgctggcggcgtgcctaatacatgcaagtcgaacgcacagcgaaaggtgcttgcacctttcaagtgagtggcgaacgggtgagtaacacgtgaataacctgccttatagtaggggataacatttggaaacagatgctaataccgtataaaacaactttttgcataaaaggttgttaaaaggcgcttcggcgtcgctaaaagatggattcgcgctgcattagttagttggtgaggtaaaggctcaccaagacgatgatgcatagccgagttgagagactgatcggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaatggcttaggtaggcaatgacctaagattgacggtaccataccagaaagggacggctaaatacgtgccagcagccgcggtaatacgtatgtcccgagcgttatccggatttattgggcgtaaagcgagcgcagacggttggttaagtctgaagtgaaagcccacagctcaactgtggaattgctttggaaactggctaacttgagtgcagtagaggtaagtggaactccatgtgtagcggtggaatgcgtagatatatggaagaacaccagtggcgaaggcggcttactggactgtaactgacgttgaggctcgaaagtgtgggtagcaaacaggattagataccctggtagtccacaccgtaaacgatgaatactaggtgttaggaggtttccgcctcttagtgccgcagcaaacgcattaagtattccgcctggggagtacgaccgcaaggttgaaactcaaaggaattgacggggacccgcacaagcggtggagcatgtggtttaattcgaagcaacgcgaagaaccttaccaggtcttgacatcctttgaagatgttagagataacattgtgctcttcggagccaaagtgacaggtggtgcatggtcgtcgtcagctcgtgtcgtgagatgttgggttaagtcccgcaacgagcgcaacccttattgttagttgccagcatttagttgggcactctagcgagactgccggtgacaaaccggaggaaggcggggacgacgtcagatcatcatgccccttatgacctgggctacacacgtgctacaatggcgtatacaacgagtcgcaaacccgcgagggcaagctaatctcttaaagtacgtctcagttcggattgtagtctgcaactcgactacatgaagtcggaatcgctagtaatcgcggatcagcatgccgcggtgaatacgttcccgggtcttgtacacaccgcccgtcacaccatgggagtttgtaatgcccaaagccggtggcctaaccttttggagggagccgtctaaggcaggacagatgactggggtgaagtcgtaacaaggtagccgtaggagaacctgcggctggatcacctcctttctaaggaa

SEQ ID NO: 5078 - DNA, 1519 bp, Leucothrix sp. C3212
  ref <308>: DATABASE ACCESSION NUMBER: NCBI ACCESSION: NZ_ML137148.1
  ref <309>: DATABASE ENTRY DATE: 2019-04-01
  ref <313>: RELEVANT RESIDUES IN SEQ ID NO: (1)..(1519)
gatcatggctcagattgaacgctggcggcaggcttaacacatgcaagtcgaacgatgaaactctagcttgctagagatgattagtggcggacgggtgagtaacatttaggaatctgcctagtagtgggggatagctcggggaaactcgaattaataccgcatacgacctacgggtgaaagggggcgcaagctcttgctattagatgagcctaaatcagattagctagttggtggggtaaaggcccaccaaggcgacgatctgtaactggtctgagaggatgatcagtcacaccggaactgagacacggtccggactcctacgggaggcagcagtggggaatattggacaatgggggcaaccctgatccagccatgccgcgtgtgtgaagaaggccttttggttgtaaagcactttaagcagggaggagaggctaatggttaatacccattagattagacgttacctgcagaataagcaccggctaactctgtgccagcagccgcggtaatacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacaggattagataccctggtagtccacgccgtaaacgatgtctactagccgttggggtccttgagactttagtggcgcagttaacgcgataagtagaccgcctggggagtacggccgcaaggttaaaactcaaatgaattgacgggggcccgcacaagcggtggagcatgtggtttaattcgatgcaacgcgaagaaccttacctggtcttgacatagtgagaatctttcagagatgagagagtgccttcgggaattcacatacaggtgctgcatggctgtcgtcagctcgtgtcgtgagatgttgggttaagtcccgcaacgagcgcaacccttttccttatttgccagcgggttaagccgggaactttaaggatactgccagtgacaaactggaggaaggcggggacgacgtcaagtcatcatggcccttacgaccagggctacacacgtgctacaatggtaggtacagagggttgctacacagcgatgtgatgctaatctcaaaaagcctatcgtagtccggattggagtctgcaactcgactccatgaagtcggaatcgctagtaatcgcagatcagaatgctgcggtgaatacgttcccgggccttgtacacaccgcccgtcacaccatgggagtctattgcaccagaagtaggtagcctaacgtaagagggcgcttaccacggtgtggtcgatgactggggtgaagtcgtaacaaggtagccgtaggggaacctgcggctggatcacctccttaa

SEQ ID NO: 5079 - DNA, 1053 bp, Leucothrix sp. IMCC9719
  ref <308>: DATABASE ACCESSION NUMBER: NCBI ACCESSION: NZ_QGKL01000021.1
  ref <309>: DATABASE ENTRY DATE: 2019-04-01
  ref <313>: RELEVANT RESIDUES IN SEQ ID NO: (1)..(1053)
taactgaagagtttgatcctggctcagattgaacgctggcggcatgcttaacacatgcaagtcgaacggtaacaggctagcttgctagtgctgacgagtggcggacgggtgagtaacgcgtaggaatctacccagttgtgggggatagcccggagaaatccggattaataccgcatacgccctacgggggaaaacaggggatcttcggaccttgtgcaattggatgagcctgcgttagattagctagttggtgaggtaagagctcaccaaggctacgatctatagctggtctgagaggatgatcagccacatcgggactgagacacggcccggactcctacgggaggcagcagtggggaatattggacaatggacgaaagtctgatccagcaatgccgcgtgtgtgaagaaggcctgagggttgtaaagcactttcaattgtgaagaagggtttagtattaatagtgctagccttgacgttaactttagaagaagcaccggctaactccgtgccagcagccgcggtaatacggagggtgcaagcgttaatcggaattactgggcgtaaagcgcgcgtaggcggttatttaagtcagatgtgaaagccccgggctcaacctgggaattgcctctgatactgggtaactagagtttggaagaggagagtagaatttcaggtgtagcggtgaaatgcatagagatctgaaggaataccagtggcgaaggcggctctctggtccaaaactgacgctgaggtgcgaaagcgtgggtagcaaacgggattagataccccggtagtccacgccgtaaacgatgtcaactagccgttgggagccttgtgttcttagtggcgcagctaacgcattaagttgaccgcctggggagtacggtcgcaagactaaaactcaaaggaattgacgggggcccgcacaagcggtggagcatgtggtttaattcgatgcaacgcgaagaaccttaccatcccttgacatccagtgaatattgcagagatgctttagtgccttcgggagcactgagacaggtgctgcatgg

SEQ ID NO: 5080 - DNA, 1522 bp, Lewinella cohaerens
  ref <308>: DATABASE ACCESSION NUMBER: NCBI ACCESSION: NZ_KB903548.1
  ref <309>: DATABASE ENTRY DATE: 2019-04-01
  ref <313>: RELEVANT RESIDUES IN SEQ ID NO: (1)..(1522)
tactatggagagtttgatcctggctcaggatgaacgctagcgggaggcttaatacatgcaagtcgagcgagaagctaccttcgggtagtgggcagcggcgcacgggtgagtaacgcgtacacaatctaccttatagaggagaatagccctgggaaactgggattaatgctccatagtattacactttggcatcaaggtgtaattaaagctccggcgctatgagatgagtgtgcgtactattagctagttggtaaggtaacggcttaccaaggctacgatagttagggggcgtgagagcgtgaccccccacacgggtactgagacacggacccgactcctacgggaggcagcagtaaggaatattggacaatgggcgaaagcctgatccagccatcccgcgtggaggatgactgccctatgggttgtaaactccttttatttgagaagaaacgcctggatttatccgggcctgacggtatcttatgaataagcaccggctaactccgtgccagcagccgcggtaatacggagggtgcaagcgttatccggaatcactgggtttaaagggtgcgtaggtggtttagtaagtcagatgtgaaagcccggcgcttaacgtcggaattgcatttgatactgctgaacttgaatcaggttgaggtgggcggaatgtggcatgtagcggtgaaatgcatagatatgccatagaacaccaattgcgaaggcagctcactggccctgaattgacactgaggcacgaaagcgtggggagcgaacaggattagataccctggtagtccacgccctaaacgatgcttactcgatattcggtcgtaagacggagtgtccaagggaaaccgataagtaagccacctggggagtacgttcgcaagaatgaaactcaaaggaattgacgggggtccgcacaagcggtggagcatgtggtttaattcgatgatacgcgaggaaccttacctgggctctaatgcgcgtgaccgatcctgaaagggattttctcttcggagcacaaagcaaggtgctgcatggctgtcgtcagctcgtgccgtgaggtgttgggttaagtcccgcaacgagcgcaacccctattcctagttgccagcacgtaatggtggggactctagggagactgccggcgtaagccgtgaggaaggtggggacgacgtcaagtcatcatggcctttatgcccagggctacacacgtgctacaatggcgtatacagagggtagcgaagccgcgaggtggagccaatcccataaagtacgtcccagttcggattggagtctggaactcgactccatgaaggcggaatcgctagtaatcgcgcatcagccatggcgcggtgaatacgttcccggaccttgtacacaccgcccgtcaaaccatggaagctgggggtgcctgaagacggtgaccatagaggaactgtctagggtaaaatcagtaactggggttaagtcgtaacaaggtagccgtaccggaaggtgtggctggaatacctccttt

SEQ ID NO: 5081 - DNA, 1525 bp, Lewinella sp. IMCC34183
  ref <308>: DATABASE ACCESSION NUMBER: NCBI ACCESSION: NZ_QMEM01000023.1
  ref <309>: DATABASE ENTRY DATE: 2019-04-01
  ref <313>: RELEVANT RESIDUES IN SEQ ID NO: (1)..(1525)
tacaatggagagtttgatcctggctcaggatgaacgctagcgggaggcttaatacatgcaagtcgagcgagaaggtggcttcggtcaccggaaagcggcgcacgggtgagtaacgcgtacgcaatctaccccctactgcggaatagccccgggaaactgggattaataccgcatggtctaactgttctgcatgggatagttagtaaagattcatcggtaggggatgagcgtgcgtactattagctagttggtagggtaacggcctaccaaggcgatgatagttagggggcgtgagagcgtgaccccccacacgggtactgagacacggacccgactcctacgggaggcagcagtaaggaatattggacaatggaggcaactctgatccagccatcccgcgtgcaggatgacggcgctacgcgttgtaaactgcttttgtgtaagatgaaacgccgggatttatcctggtctgacgttattacaagaataagcaccggctaactccgtgccagcagccgcggtaatacggagggtgcaagcgttatccggaatcactgggtttaaagggtgcgtaggcgggcctgtaagtcagaggtgaaagcccaccgcttaacggtggaattgcccctgatactgcgggtcttgaattaggttgaggttagcggaatgtggcatgtagcggtgaaatgcttagatatgccatagaacaccgattgcgaaggcagctaactggcccttgattgacgctgaggcacgaaagcgtggggagcgaacaggattagataccctggtagtccacgccctaaacgatgtttactcgatattcgccgcttagcggtgagtgtccaagggaaaccgataagtaaaccacctggggagtacgttcgcaagaatgaaactcaaaggaattgacgggggtccgcacaagcggtggagcatgtggtttaattcgatgatacgcgaggaaccttacctgggctcgaatgggtccggaccgccggtgaaagccggtttcccttcggggccggattcaaggtgctgcatggctgtcgtcagctcgtgccgtgaggtgttgggttaagtcccgcaacgagcgcaacccctatacttagttgccagcacgtaatggtggggactctaggtagactgcccgtgtaagcggagaggaaggtggggacgacgtcaagtcatcatggcctttatgcccagggctacacacgtgctacaatggtgcatacagagggtagcgaactcgcgagggtaagccaatctcagaaagtgcatctcagttcggatcggagtctggaactcgactccgtgaaggtggaatcgctagtaatcgcgcatcagccatggcgcggtgaatacgttcccggaccttgtacacaccgcccgtcaaaccatggaagccggggatgcctgaagacggtggccgttataggagctgtctagggtaaaatcggtaactggggttaagtcgtaacaaggtagccgtaccggaaggtgcggctggaatacctccttt

SEQ ID NO: 5082 - DNA, 1341 bp, Lewinella sp. IMCC34191
  ref <308>: DATABASE ACCESSION NUMBER: NCBI ACCESSION: NZ_QNQZ01000028.1
  ref <309>: DATABASE ENTRY DATE: 2019-04-01
  ref <313>: RELEVANT RESIDUES IN SEQ ID NO: (1)..(1341)
ttccgcatgggatgtttagtaaagatttattggtaagggatgagcgtgcgtactattagctagttggtagggtaacggcttaccaaggcgatgatagttagggggcgtgagagcgtgatcccccacacgggtactgagacacggacccgactcctacgggaggcagcagtaaggaatattggacaatggaggaaactctgatccagccatcccgcgtgcaggatgacggcgctacgcgttgtaaactgcttttggacaagatgaaaccgctccatttatggagtcttgacgttattgtcagaataagcaccggctaactccgtgccagcagccgcggtaatacggagggtgcaagcgttatccggaatcactgggtttaaagggtgcgtaggcgggcctgtaagtcagaggtgaaatcccgcagcttaactgcggaattgcctttgatactgcgggtcttgaattaggttgaggttagcggaatgtggcatgtagcggtgaaatgcttagatatgccatagaacaccgattgcgaaggcagctaactggcccttgattgacgctgaggcacgaaagcgtggggagcgaacaggattagataccctggtagtccacgccctaaacgatgtttactcgatattcgccgcttagcggtgagtgtctaagggaaaccgataagtaaaccacctggggagtacgttcgcaagaatgaaactcaaaggaattgacgggggtccgcacaagcggtggagcatgtggtttaattcgatgatacgcgaggaaccttacctgggctcgaatgggtccggaccgccggtgaaagccggtttcccttcggggccggattcaaggtgctgcatggctgtcgtcagctcgtgccgtgaggtgttgggttaagtcccgcaacgagcgcaacccctatacttagttgccagcacgttaaggtggggactctaggtagactgcccgtgtaagcggagaggaaggtggggacgacgtcaagtcatcatggcctttatgcccagggctacacacgtgctacaatggtgcctacagagggtagcgaaccggcgacggtaagccaatctcagaaagggcatctcagttcggatcggagtctggaactcgactccgtgaaggtggaatcgctagtaatcgcgcatcagccatggcgcggtgaatacgttcccggaccttgtacacaccgcccgtcaaaccatggaagccgggagtgcctgaagacggtggccgttataggagctgtctagggtaaaatcggtaactggggttaagtcgtaacaaggtagccgtaccggaaggtgcggctggaatacctccttt

SEQ ID NO: 5083 - DNA, 1507 bp, Liberibacter crescens
  ref <308>: DATABASE ACCESSION NUMBER: NCBI ACCESSION: NZ_CP010522.1
  ref <309>: DATABASE ENTRY DATE: 2019-04-01
  ref <313>: RELEVANT RESIDUES IN SEQ ID NO: (1)..(1507)
cttttgaattgaacatgagagtttgatcctggctcagaacgaacgctggcggcaggcttaacacatgcaagtcgagcgcgtatttatacgagcggcagacgggtgagtaacgcgtgggaatctacctttttctacaggataacgcatggaaacgtgtgctaatactgtatacgcccttttggggaaagatttattggagagagatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggggcaaccctgatccagccatgccgcgtgagtgaagaaggccctagggttgtaaagctctttcaccggagaagataatgacggtatccggagaagaagccccggctaacttcgtgccagcagccgcggtaatacgaagggggcgagcgttgttcggaataactgggcgtaaagggcgcgtaggcggatgattaagtcagtggtgaaatcccaaggctcaaccttggaactgcctctgatactggttatcttgagttcagaagaggtgagtggaattccgagtgtagaggtgaaattcgtagatattcggaggaacaccagtggcgaaggcggctcactggtctgatactgacgctgaggtgcgaaagcgtggggagcaaacaggattagataccctggtagtccacgctgtaaacgatgagtgctagctgttgggcagtttactgcttagtggcgcagctaacgcattaagcactccgcctggggagtacggtcgcaagattaaaactcaaaggaattgacgggggcccgcacaagcggtggagcatgtggtttaattcgaagcaacgcgcagaaccttaccagcccttgacatggcgtgacgaataccagagatggtattttcttcttcggaggcacgcacacaggtgctgcatggctgtcgtcagctcgtgtcgtgagatgttgggttaagtcccgcaacgagcgcaaccctcgcctctagttgccatcattaagttgggcactctatggggactgccggcgataagccggaggaaggtggggatgacgtcaagtcctcatggcccttatgggctgggctacacacgtgctacaatggtggtgacaatgggcagcgaagtcgtgaggcggagctaatctccaaaagccatctcagttcggattgcactctgcaactcgagtgcatgaagttggaatcgctagtaatcgcggatcagcatgccgcggtgaatacgttctcgggccttgtacacaccgcccgtcacaccatgggagttggttttaccttaagacggtgcgctaaccgcaaggaggcagccggccacggtaaggtcagcgactggggtgaagtcgtaacaaggtagccgtaggggaacctgcggctggatcacctcctttctaagggaaattttt

SEQ ID NO: 5084 - DNA, 1526 bp, Lihuaxuella thermophila
  ref <308>: DATABASE ACCESSION NUMBER: NCBI ACCESSION: NZ_FOCQ01000035.1
  ref <309>: DATABASE ENTRY DATE: 2019-04-01
  ref <313>: RELEVANT RESIDUES IN SEQ ID NO: (1)..(1526)
ttgatggagagtttgatcctggctcaggacgaacgctggcggcgtgcctaatacatgcaagtcgagcggggtttgcttcttcggaagtaaacctagcggcgaacgggtgagtaacacgtgggcaacctgccctcaagaccgggataacaccgggaaaccggtgctaataccggataatcctccctctcgcatgagagggaagtaaaaggcttcggccacttgaggatgggcccgcggcgcattagctagttggtgaggtaacggctcaccaaggcgacgatgcgtagccgacctgagagggtgaccggccacactgggactgagacacggcccagactcctacgggaggcagcagtagggaattttccgcaatgggcgaaagcctgacggagcaacgccgcgtgagtgaagacggccttcgggttgtaaaactctgttcttggggaagaagctctgacggtacccaaggagaaagccccggctaactacgtgccagcagccgcggtaatacgtagggggcgagcgttgtccggaattattgggcgtaaagcgcgcgcaggcggctctttaagtcaggtgtgaaaggctgcggctcaaccgcagagcggcacctgaaactggagagcttgagtgcaggagaggggagcggaattcccggtgtagcggtggaatgcgtagagatcgggaggaacaccagtggcgaaggcggctctctggcctgtaactgacgctgaggcgcgaaagcgtggggagcaaacaggattagataccctggtagtccacgccgtaaacgatgagtgctaggtgttgggggcgttacgccctcagtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccgctccagagatggagcttcccttcggggcagcggtgacaggtggtgcatggttgtcgtcagctcgtgtcgtgagatgttgggttcagtcccgcaacgagcgcaacccttatcgtcagttgccagcacttcgggtgggcactctggcgagacagccggtgaaagccggaggaaggtggggatgacgtcaaatcatcatgccccttatgtcctgggctacacacgtgctacaatggctggtacaaagggcagcaaacccgcgagggggagccaatcccaaaaaaccagtctcagttcggatcgcaggctgcaactcgcctgcgtgaagccggaatcgctagtaatcgcggatcagcatgccgcggtgaatacgttcccgggccttgtacacaccgcccgtcacaccacgagagtttgcaacacccgaagtcggtgaggtaacccgcaagggagccagccgccgaaggtggggcaaatgattggggtgaagtcgtaacaaggtatccctaccggaaggtggggatggatcacctcctttctacggag

SEQ ID NO: 5085 - DNA, 1228 bp, Limimaricola cinnabarinus
  ref <308>: DATABASE ACCESSION NUMBER: NCBI ACCESSION: NZ_KZ305003.1
  ref <309>: DATABASE ENTRY DATE: 2019-04-01
  ref <313>: RELEVANT RESIDUES IN SEQ ID NO: (1)..(1228)
gggaaactgggtttaataccgtatacgccctttgggggaaagatttatcggagaaggatcggcccgcgtctgattagatagttggtggggtaacggcctaccaagtcgacgatcagtagctggtttgagaggatgatcagcaacactgggactgagacacggcccagactcctacgggaggcagcagtggggaatcttagacaatgggcgcaagcctgatctagccatgccgcgtgagtgatgaaggccctagggtcgtaaagctctttcgctggggaagataatgacggtacccagtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaactgcctccaaaactatcagtctagaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgctggagagatccagttttctcgtaagagaccgagtgacaggtgctgcatggctgtcgtcagctcgtgtcgtgagatgttcggttaagtccggcaacgagcgcaacccacacccctagttgccagcattcggttgggcactctaggggaactgcccgtgataagcgggaggaaggtgtggatgacgtcaagtcctcatggcccttacgggttgggctacacacgtgctacaatggcatcaacaatgggttaatccctaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaa

SEQ ID NO: 5086 - DNA, 1466 bp, Limimaricola hongkongensis
  ref <308>: DATABASE ACCESSION NUMBER: NCBI ACCESSION: NZ_KK088653.1
  ref <309>: DATABASE ENTRY DATE: 2019-04-01
  ref <313>: RELEVANT RESIDUES IN SEQ ID NO: (1)..(1466)
tcaacttgagagtttgatcctggctcagaacgaacgctggcggcaggcctaacacatgcaagtcgagcgagaccttcgggtctagcggcggacgggttagtaacgcgtgggaacgtgcccttcactacggaatagtcccgggaaactgggtttaataccgtatacgccccttgggggaaagatttatcggtgaaggatcggcccgcgtctgattagatagttggtggggtaacggcctaccaagtcgacgatcagtagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgctggggaagataatgacggtacccagtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaactgcctccaaaactatcagtctagaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgtcgcagagatgcgtctttctcgtaagagaccgagtgacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggcatcaacaatgggttaatccctaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttctaa

SEQ ID NO: 5087 - DNA, 1467 bp, Limimaricola pyoseonensis
  ref <308>: DATABASE ACCESSION NUMBER: NCBI ACCESSION: NZ_FNAT01000020.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgaagccttcgggcttagcggcggacgggttagtaacgcgtgggaacgtgcctctctgtacggaacagtcccgggaaactgggtttaataccgtatacgcccttcgggggaaagatttatcgcagagagatcggcccgcgtctgattagatagttggtggggtaacggcctaccaagtcgacgatcagtagctggtttgagaggatgatcagcaacactgggactgagacacggcccagactcctacgggaggcagcagtggggaatcttagacaatgggcgcaagcctgatctagccatgccgcgtgagtgatgaaggccctagggtcgtaaagctctttcgctggggaagataatgacggtacccagtaaagaaaccccggctaactccgtgccagcagccgcggtaatacggagggggttagcgttgttcggaattactgggcgtaaagcgcgcgtaggcggatcggaaagttgggggtgaaatcccggggctcaaccccggaacggcctccaaaactatcggtctagaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgggaccgccagagagatctggttttcacttcggtgacccggtgacaggtgctgcatggctgtcgtcagctcgtgtcgtgagatgttcggttaagtccggcaacgagcgcaacccacacccctagttgccagcatttggttgggcactctaggggaactgcccgtgataagcgggaggaaggtgtggatgacgtcaagtcctcatggcccttacgggttgggctacacacgtgctacaatggtgcctacagtgggttaatccccaaaaggcatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgacggccgtgcgctaacccttcggggaggcagcggaccacggtaagctcagcgactggggtgaagtcgtaacaaggtagccgtaggggaacctgcggctggatcacctcctttctaa

SEQ ID NO: 5088 - DNA, 1468 bp, Limimaricola soesokkakensis
  ref <308>: DATABASE ACCESSION NUMBER: NCBI ACCESSION: NZ_FWFY01000030.1
  ref <309>: DATABASE ENTRY DATE: 2019-04-01
  ref <313>: RELEVANT RESIDUES IN SEQ ID NO: (1)..(1468)
tcaacttgagagtttgatcctggctcagaacgaacgctggcggcaggcctaacacatgcaagtcgaacgaagccttcgggcttagtggcggacgggttagtaacgcgtgggaacgtgcccttctctacggaatagtcccgggaaactgggtttaataccgtatacgcccttcgggggaaagatttatcggggaaggatcggcccgcgtctgattagatagttggtggggtaatggcctaccaagtcgacgatcagtagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaacggcctccaaaactatcagtctagaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgtcgcagagatgcgtctttctcgtaagagaccgagtgacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggcatcaacaatgggttaatccctaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 5089 - DNA, 1543 bp, Limnochorda pilosa
  ref <308>: DATABASE ACCESSION NUMBER: NCBI ACCESSION: NZ_AP014924.1
  ref <309>: DATABASE ENTRY DATE: 2019-04-01
  ref <313>: RELEVANT RESIDUES IN SEQ ID NO: (1)..(1543)
cggagagtttgatcctggctcaggacgaacgctggcggcgtgcctcatacatgcaagtcgagcggacccttggtgcggaagccttcgggcggaagggccaggggttagcggcggacgggtgagtaacgcgtgggcaacctgccctccagagggggataactcgccgaaaggcgggctaataccgcatgagttccttccggggcatctcggaaggagcaaaggccttcgggccgctggaggaggggcctgcgtcccattagctcgttggcggggtaacggcccaccaaggcgacgatgggtagccggcctgagagggtggacggccacactgggactgagatacggcccagactcctacgggaggcagcagtagggaatcttgcgcaatgggcgaaagcctgacgcagcgacgccgcgtgggggaagaaggccttcgggtcgtaaacccctgtcccaggggacgagaagggacggtaccctgggaggaagccccggctaactacgtgccagcagccgcggtaatacgtagggggcgagcgttgtccggaatgactgggcgtaaagggtgcgtaggcggcccgagaggtcctgggtgaaaggccccggctcaaccggggagggccccaggaaaccggcgggctagagggctggagagggccgcggaattcccggtgtagcggtgaaatgcgtagatatcgggaagaacaccagtggcgaaggcggcggcctggacagaacctgacgctgaggcacgaaagctgggggagcgaacaggattagataccctggtagtcccagctgtaaacgatgagtgctaggtgtggtgggggagatccctgccgtgccgcaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgcgaacccccgggaaaccggggggtgcccttcggggagcgcggagacaggtggtgcatggttgtcgtcagctcgtgtcgtgagatgttgggttaagtcccgcaacgagcgcaacccctatccgatgttgccagcccacgggggggcactcatcggagactgccggcgacaagccggaggaaggcggggatgaggtcaaatcatcatgccccttatgccctgggcgacacacgtgctacaatggccggaacagcgggaagcgaaagggcgacctggagcgaatccctgtaaatccggtcccagttcggatcgcaggctgcaacccgcctgcgtgaaggcggaatcgctagtaatcgcgggtcagcataccgcggtgaatacgttcccgggccttgtacacaccgcccgtcacaccacgaaagtcgggaagacccgaagccggtggcccaacctgcaaaggggggagccgtcgaaggtcggcccgatgattggggtgaagtcgtaacaaggtagccgtatcggaaggtgcggctggatcacctcctttctaaggag

SEQ ID NO: 5090 - DNA, 1536 bp, Limnohabitans planktonicus
  ref <308>: DATABASE ACCESSION NUMBER: NCBI ACCESSION: NZ_LFYT02000071.1
  ref <309>: DATABASE ENTRY DATE: 2019-04-01
  ref <313>: RELEVANT RESIDUES IN SEQ ID NO: (1)..(1536)
gaactatagagtttgatcctggctcagattgaacgctggcggaatgctttacacatgcaagtcgaacggtagagggggcaaccccttgagagtggcgaacgggtgagtaatatatcggaacgtgcccagtcgtgggggataacgtagcgaaagttacgctaataccgcatacgatctaaggatgaaagcgggggactcgcaagagcctcgcgcgattggagcggccgatatcagattaggtagttggtggggtaaaggctcaccaagccaacgatctgtagctggtctgagaggacgaccagccacactggaactgagacacggtccagactcctacgggaggcagcagtggggaattttggacaatggacgcaagtctgatccagccattccgcgtgcaggatgaaggccctcgggttgtaaactgcttttgtacggaacgaaaaggtttctattaatactaggagctcatgacggtaccgtaagaataagcaccggctaactacgtgccagcagccgcggtaatacgtagggtgcaagcgttaatcggaattactgggcgtaaagcgtgcgcaggcggttatgtaagacagaggtgaaatccccgggctcaacctgggaactgcctttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagtcgctagagatagcttcgtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggtctcgccagaagtagttagcctaaccgcaaggagggcgattaccacggcggggttcgtgactggggtgaagtcgtaacaaggtagccgtatcggaaggtgcggctggatcacctcctttctg

SEQ ID NO: 5091 - DNA, 1536 bp, Limnohabitans sp. 2KL-1
  ref <308>: DATABASE ACCESSION NUMBER: NCBI ACCESSION: NZ_NESL01000010.1
  ref <309>: DATABASE ENTRY DATE: 2019-04-01
  ref <313>: RELEVANT RESIDUES IN SEQ ID NO: (1)..(1536)
gaactatagagtttgatcctggctcagattgaacgctggcggaatgctttacacatgcaagtcgaacggtagagggggcaacccctcgagagtggcgaacgggtgagtaatatatcggaacgtgcccagtcgtgggggataacgtagcgaaagttacgctaataccgcatacgatctaaggatgaaagcgggggactcgcaagagcctcgcgcgattggagcggccgatatcagattaggtagttggtggggtaaaggctcaccaagccaacgatctgtagctggtctgagaggacgaccagccacactggaactgagacacggtccagactcctacgggaggcagcagtggggaattttggacaatggacgaaagtctgatccagccattccgcgtgcaggatgaaggccctcgggttgtaaactgcttttgtacggaacgaaaaggtttctattaatactaggagctcatgacggtaccgtaagaataagcaccggctaactacgtgccagcagccgcggtaatacgtagggtgcaagcgttaatcggaattactgggcgtaaagcgtgcgcaggcggttatgtaagacagaggtgaaatccccgggctcaacctgggaactgcctttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagtcgctagagatagcttcgtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggtctcgccagaagtagttagcctaaccgtaaggagggcgattaccacggcggggttcgtgactggggtgaagtcgtaacaaggtagccgtatcggaaggtgcggctggatcacctcctttctg

SEQ ID NO: 5092 - DNA, 1534 bp, Limnohabitans sp. 2KL-51
  ref <308>: DATABASE ACCESSION NUMBER: NCBI ACCESSION: NZ_NESJ01000025.1
  ref <309>: DATABASE ENTRY DATE: 2019-04-01
  ref <313>: RELEVANT RESIDUES IN SEQ ID NO: (1)..(1534)
gaactatagagtttgatcctggctcagattgaacgctggcggaatgctttacacatgcaagtcgaacggtagagggggcaaccccttgagagtggcgaacgggtgagtaatatatcggaacgtgcccagtcgtgggggataacgtagcgaaagttacgctaataccgcatacgatctaaggatgaaagcgggggatcgcaagacctcgcgcgattggagcggccgatatcagattaggtagttggtggggtaaaggctcaccaagccaacgatctgtagctggtctgagaggacgaccagccacactggaactgagacacggtccagactcctacgggaggcagcagtggggaattttggacaatggacgcaagtctgatccagccattccgcgtgcaggatgaaggccctcgggttgtaaactgcttttgtacggaacgaaaaggtttctcttaatacgaggagctcatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagcctttagagatagaggcgtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagccaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggtctcgccagaagtagttagcctaaccgcaaggagggcgattaccacggcggggttcgtgactggggtgaagtcgtaacaaggtagccgtatcggaaggtgcggctggatcacctcctttctg

SEQ ID NO: 5093 - DNA, 1541 bp, Limnohabitans sp. Jir72
  ref <308>: DATABASE ACCESSION NUMBER: NCBI ACCESSION: NZ_NESC01000017.1
  ref <309>: DATABASE ENTRY DATE: 2019-04-01
  ref <313>: RELEVANT RESIDUES IN SEQ ID NO: (1)..(1541)
agatcgaactatagagtttgatcctggctcagattgaacgctggcggaatgctttacacatgcaagtcgaacggtagagggggcaaccccttgagagtggcgaacgggtgagtaatatatcggaacgtgcccagtcgtgggggataacgtagcgaaagttacgctaataccgcatacgatctacggatgaaagcgggggactcgcaagagcctcgcgcgattggagcggccgatatcagattaggtagttggtggggtaaaggctcaccaagccaacgatctgtagctggtctgagaggacgaccagccacactggaactgagacacggtccagactcctacgggaggcagcagtggggaattttggacaatggacgcaagtctgatccagccattccgcgtgcaggatgaaggccctcgggttgtaaactgcttttgtacggaacgaaaaggtctctcttaatacgaggggctcatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagtcgctagagatagcttcgtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggtctcgccagaagtagttagcctaaccgcaaggagggcgattaccacggcggggttcgtgactggggtgaagtcgtaacaaggtagccgtatcggaaggtgcggctggatcacctcctttctg

SEQ ID NO: 5094 - DNA, 1538 bp, Limnohabitans sp. JirII-29
  ref <308>: DATABASE ACCESSION NUMBER: NCBI ACCESSION: NZ_NESB01000008.1
  ref <309>: DATABASE ENTRY DATE: 2019-04-01
  ref <313>: RELEVANT RESIDUES IN SEQ ID NO: (1)..(1538)
gaactatagagtttgatcctggctcagattgaacgctggcggaatgctttacacatgcaagtcgaacggcagcacgagggtaaccttggtggcgagtggcgaacgggtgagtaatatatcggaacgtgcccagtcgtgggggataacgtagtgaaaattacgctaataccgcatacgatctatggatgaaagcgggggatcgcaagacctcgcgcgattggagcggccgatatcagattaggtagttggtggggtaaaggctcaccaagccaacgatctgtagctggtctgagaggacgaccagccacactggaactgagacacggtccagactcctacgggaggcagcagtggggaattttggacaatggacgcaagtctgatccagccattccgcgtgcaggacgaaggccttcgggttgtaaactgcttttgtacggaacgaaaaggtttctcttaatacgaggggctcatgacggtaccgtaagaataagcaccggctaactacgtgccagcagccgcggtaatacgtagggtgcaagcgttaatcggaattactgggcgtaaagcgtgcgcaggcggttatataagacagatgtgaaatcgccgggctcaacctgggaactgcatgtgtgactgtataggtggagtacggcagagggggatggaattccgcgggtagcagtgaaatgcgtagatatgcgggggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccgtaaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcctaaccgtaaggagggcgattaccacggcagggttcgtgactggggtgaagtcgtaacaaggtagccgtatcggaaggtgcggctggatcacctcctttctg

SEQ ID NO: 5095 - DNA, 1534 bp, Limnohabitans sp. Rim28
  ref <308>: DATABASE ACCESSION NUMBER: NCBI ACCESSION: NZ_ALKN02000011.1
  ref <309>: DATABASE ENTRY DATE: 2019-04-01
  ref <313>: RELEVANT RESIDUES IN SEQ ID NO: (1)..(1534)
gaactatagagtttgatcctggctcagattgaacgctggcggaatgctttacacatgcaagtcgaacggtagagggggcaacccctcgagagtggcgaacgggtgagtaatatatcggaacgtgcccagtcgtgggggataacgtagcgaaagttacgctaataccgcatacgatctacggatgaaagcgggggatcgcaagacctcgcgcgattggagcggccgatatcagattaggtagttggtggggtaaaggctcaccaagccaacgatctgtagctggtctgagaggacgaccagccacactggaactgagacacggtccagactcctacgggaggcagcagtggggaattttggacaatggacgcaagtctgatccagccattccgcgtgcaggatgaaggccctcgggttgtaaactgcttttgtacggaacgaaaaggtttctattaatactaggagctcatgacggtaccgtaagaataagcaccggctaactacgtgccagcagccgcggtaatacgtagggtgcaagcgttaatcggaattactgggcgtaaagcgtgcgcaggcggttatgtaagacagaggtgaaatccccgggctcaacctgggaactgcctttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagcctttagagatagaggcgtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggtctcgccagaagtagttagcctaaccgcaaggagggcgattaccacggcggggttcgtgactggggtgaagtcgtaacaaggtagccgtatcggaaggtgcggctggatcacctcctttctg

SEQ ID NO: 5096 - DNA, 1539 bp, Limnohabitans sp. T6-20
  ref <308>: DATABASE ACCESSION NUMBER: NCBI ACCESSION: NZ_NERW01000001.1
  ref <309>: DATABASE ENTRY DATE: 2019-04-01
  ref <313>: RELEVANT RESIDUES IN SEQ ID NO: (1)..(1539)
agatcgaactatagagtttgatcctggctcagattgaacgctggcggaatgctttacacatgcaagtcgaacggtagagggggcaacccctcgagagtggcgaacgggtgagtaatatatcggaacgtgcccagtcgtgggggataacgtagcgaaagttacgctaataccgcatacgatctaaggatgaaagcgggggatcgcaagacctcgcgcgattggagcggccgatatcagattaggtagttggtggggtaaaggctcaccaagccaacgatctgtagctggtctgagaggacgaccagccacactggaactgagacacggtccagactcctacgggaggcagcagtggggaattttggacaatggacgaaagtctgatccagccattccgcgtgcaggatgaaggccctcgggttgtaaactgcttttgtacggaacgaaaaggtttctattaatactaggagctcatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagtcgctagagatagcttcgtgctcgaaagagaaccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggtctcgccagaagtagttagcctaaccgcaaggagggcgattaccacggcggggttcgtgactggggtgaagtcgtaacaaggtagccgtatcggaaggtgcggctggatcacctcctttctg

SEQ ID NO: 5097 - DNA, 1539 bp, Limnohabitans sp. WS1
  ref <308>: DATABASE ACCESSION NUMBER: NCBI ACCESSION: NZ_NERU01000018.1
  ref <309>: DATABASE ENTRY DATE: 2019-04-01
  ref <313>: RELEVANT RESIDUES IN SEQ ID NO: (1)..(1539)
agatcgaactatagagtttgatcctggctcagattgaacgctggcggaatgctttacacatgcaagtcgaacggtagagggggcaaccccttgagagtggcgaacgggtgagtaatatatcggaacgtgcccagtcgtgggggataacgtagcgaaagttacgctaataccgcatacgatctaaggatgaaagcgggggaccgtaaggcctcgcgcgattggagcggccgatatcagattaggtagttggtggggtaaaggctcaccaagccaacgatctgtagctggtctgagaggacgaccagccacactggaactgagacacggtccagactcctacgggaggcagcagtggggaattttggacaatggacgcaagtctgatccagccattccgcgtgcaggatgaaggccctcgggttgtaaactgcttttgtacggaacgaaaaggtctctcttaatacggggggctcatgacggtaccgtaagaataagcaccggctaactacgtgccagcagccgcggtaatacgtagggtgcaagcgttaatcggaattactgggcgtaaagcgtgcgcaggcggttatgtaagacagaggtgaaatccccgggctcaacctgggaactgcctttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagtcgctagagatagcttcgtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggtctcgccagaagtagttagcctaaccgcaaggagggcgattaccacggcggggttcgtgactggggtgaagtcgtaacaaggtagccgtatcggaaggtgcggctggatcacctcctttctg

SEQ ID NO: 5098 - DNA, 1489 bp, Limnothrix rosea
  ref <308>: DATABASE ACCESSION NUMBER: NCBI ACCESSION: NZ_MRBY01000088.1
  ref <309>: DATABASE ENTRY DATE: 2019-04-01
  ref <313>: RELEVANT RESIDUES IN SEQ ID NO: (1)..(1489)
aatatggagagtttgatcctggctcaggatgaacgctggcggtatgcctaacacatgcaagtcgaacgaagtcttcggacttagtggcggacgggtgagtaacgcgtgagaatctgccttcaggatggggacaacagttggaaacgactgctaatacccaatatgcctacgggtgaaacttatttggcctgaagatgagctcgcgtctgattagctagttggtggtgtaagagactaccaaggcgacgatcagtagctggtctgagaggatgagcagccacactgggactgagacacggcccagactcctacgggaggcagcagtggggaattttccgcaatgggcgaaagcctgacggagcaataccgcgtgagggaggaaggtttttggattgtaaacctcttttctcagggaagaattttgacggtacctgaggaataagcaccggctaactccgtgccagcagccgcggtaatacggagggtgcaagcgttatccggaattattgggcgtaaagagtccgtaggtggtcatgcaagtctgctgtcaaagcccacagcttaactgtggataggcggtggaaactgcatgacttgagtacggtaggggtagagggaattcccagtgtagcggtgaaatgcgtagatattgggaagaacaccggtggcgaaagcgctctactggaccgtaactgacactgagggacgaaagccaaggtagcgaaagggattagatacccctgtagtcttggccgtaaacgatggatactaggcgttgtctgtatcgacccggacagtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagatttgacatcccgtgaactatccagagatggatgggtgccttcgggaacacggagacaggtggtgcatggctgtcgtcagctcgtgtcgtgagatgttgggttaagtcccgcaacgagcgcaaccctcgtccttagttgccatcattaagttgggcactctagggagactgccggggacaactcggaggaaggtggggatgacgtcaagtcatcatgccccttacattttgggctacacacgtactacaatggtcgggacaaagggcagcaaccccgcgagggcaagcgaatctcatcaaacccggcctcagttcagattgcaggctgcaactcgcctgcatgaaggaggaatcgctagtaatcgcaggtcagcatactgcggtgaatccgttcccgggccttgtacacaccgcccgtcacaccatggaagctggcaacgcccgaagtcgttactctaaccgttcgcggaggagggcgccgaaggcagtgctagtgactggggtgaagtcgtaacaaggtagccgtaccggaaggtgtggctggatcacctcctttt

SEQ ID NO: 5099 - DNA, 1283 bp, Listeria aquatica
  ref <308>: DATABASE ACCESSION NUMBER: NCBI ACCESSION: NZ_AOCG01000026.1
  ref <309>: DATABASE ENTRY DATE: 2019-04-01
  ref <313>: RELEVANT RESIDUES IN SEQ ID NO: (1)..(1283)
gcctaccaaggccacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggatgagttaactattcatcccctgacggtatctaaccagaaagccacggctaactacgtgccagcagccgcggtaatacgtaggtggcaagcgttgtccggaattattgggcgtaaagcgcgcgcaggcggtttcttaagttgggtgtgaaagccctcggctcaaccgaggagggtcactcaaaactgggagactggagtgcagaagaggagagtggaattccatgtgtagcggtgaaatgcgtagatatatggaggaacaccagtggcgaaggcggctctctggtctgtaactgacgctgaggcgcgaaagcgtggggagcaaacaggattagataccctggtagtccacgccgtaaacgatgagtgctaagtgttagggggtttccgccccttagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatggaacaaagggtagcgaagccgcgaggtgaagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaagga

SEQ ID NO: 5100 - DNA, 1558 bp, Listeria booriae
  ref <308>: DATABASE ACCESSION NUMBER: NCBI ACCESSION: NZ_UGPF01000007.1
  ref <309>: DATABASE ENTRY DATE: 2019-04-01
  ref <313>: RELEVANT RESIDUES IN SEQ ID NO: (1)..(1558)
tttaaagagagtttgatcctggctcaggacgaacgctggcggcgtgcctaatacatgcaagtcgaacgaaccgacgaaaagcttgcttttctgacgtgagtggcggacgggtgagtaacacgtgggcaacctgcctatcagttggggataactccgggaaaccggggctaataccgaataataacgagcgtcgcatgacgctggtttgaaagatggtttcggctatcgctgatagatgggcccgcggtgcattagctagttggtggggtaatggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgagagacttgaatgcaggagaggtaagtggaattccatgtgtagcggtgaaatgcgtagatatgtggaggaacaccagtggcgaaggcggcttactggcctgtaattgacgctgaggctcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagtggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggataatacaaagggttgccaaaccgcgaggtcgagctaatcccataaaattattctcagttcggattgtaggctgcaactcgcctacatgaagccggaatcactagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaaggaa

SEQ ID NO: 5101 - DNA, 1506 bp, Listeria cornellensis
  ref <308>: DATABASE ACCESSION NUMBER: NCBI ACCESSION: NZ_AODE01000071.1
  ref <309>: DATABASE ENTRY DATE: 2019-04-01
  ref <313>: RELEVANT RESIDUES IN SEQ ID NO: (1)..(1506)
tgcaagtcgaacgaaccgacgaaagagcttgctctttctgacgttagtggcggacgggtgagtaacacgtgggcaacctgcctgtaagttggggataactccgggaaaccggggctaataccgaataataacaagcgtcgcatgacgcctgtttgaaagatggtttcggctatcacttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgagagacttgaatgcaggagaggtaagtggaattccacgtgtagcggtgaaatgcgtagatatgtggaggaacaccagtggcgaaggcggcttactggcctgtaattgacgctgaggctcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagtggtggagcatgtggtttaattcgaagcaacgcgaagaaccttaccaggtcttgacatcctttgaccattctggagacagaactttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggataatacaaagggttgccaaaccgcgaggtcgagctaatcccataaaattattctcagttcggattgtaggctgcaactcgcctacatgaagccggaatcactagtaatcgtggatcagcatgccacggtgaatacgttcccgggccttgtacacaccgcccgtcacaccacgagagtttgtaacacccgaagtcggtagggtaaccatttatggagccagccgccgaaggtgggacagataattggggtgaagtcgtaacaaggtagccgtatcggaaggtgcggctggatcacctcctttctaaggaa

SEQ ID NO: 5102 - DNA, 1556 bp, Listeria costaricensis
  ref <308>: DATABASE ACCESSION NUMBER: NCBI ACCESSION: NZ_FXUT01000016.1
  ref <309>: DATABASE ENTRY DATE: 2019-04-01
  ref <313>: RELEVANT RESIDUES IN SEQ ID NO: (1)..(1556)
tttaacgagagtttgatcctggctcaggacgaacgctggcggcgtgcctaatacatgcaagtcgaacgaactgaagagaagcttgcttctctgacgtgagtggcggacgggtgagtaacacgtgggcaacctgcctatcagcgggggataacacttggaaacaggtgctaataccgcataatagtaaggttcacatgaaccttatttgaaagacggtttcggctgtcactgatagatgggcccgcggtgcattagctagttggtagggtaaaggcctaccaaggcgacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggatgaagtaactactcatcccctgacggtatctaaccagaaagccacggctaactacgtgccagcagccgcggtaatacgtaggtggcaagcgttgtccggaattattgggcgtaaagcgcgcgcaggcggtcttttaagtctgatgtgaaagcccccggcttaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggcgcgaaagcgtggggagcaaacaggattagataccctggtagtccacgccgtaaacgatgagtgctaagtgttagggggtttccgccccttagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatggtacaaagggtagcgaagccgcgaggtggagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaagga

SEQ ID NO: 5103 - DNA, 1559 bp, Listeria fleischmannii
  ref <308>: DATABASE ACCESSION NUMBER: NCBI ACCESSION: NZ_UAWT01000001.1
  ref <309>: DATABASE ENTRY DATE: 2019-04-01
  ref <313>: RELEVANT RESIDUES IN SEQ ID NO: (1)..(1559)
tttaaagagagtttgatcctggctcaggacgaacgctggcggcgtgcctaatacatgcaagtcgaacgaaccaaagagaagcttgcttctctgtcggtgagtggcggacgggtgagtaacacgtgggcaacctgcctatcagcgggggataacacttggaaacaggtgctaataccgcataatagagaagttcgcatgaacttcttttgaaagacggtttcggctgtcactgatagatgggcccgcggtgcattagctagttggtggggtaaaggcctaccaaggcgacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggataagagtcactgcttgtcccttgacggtatctaaccagaaagccacggctaactacgtgccagcagccgcggtaatacgtaggtggcaagcgttgtccggaattattgggcgtaaagcgcgcgcaggcggtttcttaagttgggtgtgaaagccctcggctcaaccgaggagggtcactcaaaactgggagactggagtgcagaagaggagagtggaattccatgtgtagcggtgaaatgcgtagatatatggaggaacaccagtggcgaaggcggctctctggtctgtaactgacgctgaggcgcgaaagcgtggggagcaaacaggattagataccctggtagtccacgccgtaaacgatgagtgctaagtgttagggggtttccgccccttagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatggtacaaagggcagcgaagccgtgaggtgaagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtagggtaacgcttaggcgagccagccgccgaaggtgggacagataattggggtgaagtcgtaacaaggtagccgtatcggaaggtgcggctggatcacctcctttctaagga

SEQ ID NO: 5104 - DNA, 1560 bp, Listeria floridensis
  ref <308>: DATABASE ACCESSION NUMBER: NCBI ACCESSION: NZ_AODF01000077.1
  ref <309>: DATABASE ENTRY DATE: 2019-04-01
  ref <313>: RELEVANT RESIDUES IN SEQ ID NO: (1)..(1560)
attttaacgagagtttgatcctggctcaggacgaacgctggcggcgtgcctaatacatgcaagtcgaacgaaccaaagagaagcttgcttctctgtcggtgagtggcggacgggtgagtaacacgtgggcaacctgcctatcagcgggggataacacttggaaacaggtgctaataccgcataacagtaaggttcgcatgaaccttgtttgaaagacggtttcggctgtcactgatagatgggcccgcggtgcattagctagttggtggggtaaaggcctaccaaggcgacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggagaaggtaactacttctcccctgacggtatctaaccagaaagccacggctaactacgtgccagcagccgcggtaatacgtaggtggcaagcgttgtccggaattattgggcgtaaagcgcgcgcaggcggtttcttaagtctgatgtgaaagcccccggcttaaccggggagggtcattggaaactgggagactggagtgcagaagaggagagtggaattccatgtgtagcggtgaaatgcgtagatatatggaggaacaccagtggcgaaggcggctctctggtctgtaactgacgctgaggcgcgaaagcgtggggagcaaacaggattagataccctggtagtccacgccgtaaacgatgagtgctaagtgttagggggtttccgccccttagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatggtacaaagggtagcgaagccgcgaggtggagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaaggaa

SEQ ID NO: 5105 - DNA, 1557 bp, Listeria grandensis
  ref <308>: DATABASE ACCESSION NUMBER: NCBI ACCESSION: NZ_AODD01000051.1
  ref <309>: DATABASE ENTRY DATE: 2019-04-01
  ref <313>: RELEVANT RESIDUES IN SEQ ID NO: (1)..(1557)
aaagagagtttgatcctggctcaggacgaacgctggcggcgtgcctaatacatgcaagtcgaacgaaccgaagaaagagcttgctctttcggacgttagtggcggacgggtgagtaacacgtgggcaacctgcctgtaagttggggataactccgggaaaccggggctaataccgaataataacaagcgtcgcatgacgcctgtttgaaagatggtttcggctatcacttacagatgggcccgcggtgcattagctagttggtagggtaatggcctaccaaggcgacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgagagacttgaatgcaggagaggtaagtggaattccacgtgtagcggtgaaatgcgtagatatgtggaggaacaccagtggcgaaggcggcttactggcctgtaattgacgctgaggctcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagtggtggagcatgtggtttaattcgaagcaacgcgaagaaccttaccaggtcttgacatcctttgaccattctggagacagaactttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggataatacaaagggttgccaaaccgcgaggtcgagctaatcccataaaattattctcagttcggattgtaggctgcaactcgcctacatgaagccggaatcactagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaaggaa

SEQ ID NO: 5106 - DNA, 1561 bp, Listeria grayi
  ref <308>: DATABASE ACCESSION NUMBER: NCBI ACCESSION: NZ_LR134483.1
  ref <309>: DATABASE ENTRY DATE: 2019-04-01
  ref <313>: RELEVANT RESIDUES IN SEQ ID NO: (1)..(1561)
tttaaagagagtttgatcctggctcaggacgaacgctggcggcgtgcctaatacatgcaagtcgaacgaatgaccttaggagcttgctcctttggtcgttagtggcggacgggtgagtaacacgtgggcaacctgcctgtaagattgggataactccgggaaaccggagctaataccgaataataatcagctccgcatggagcaggtttgaaaggcggcttcggctgtcacttacagatgggcccgcggtgcattagctagttggtggggtaaaggcctaccaaggcgacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggataagagtaactgcttgtcccttgacggtatctaaccagaaagccacggctaactacgtgccagcagccgcggtaatacgtaggtggcaagcgttgtccggaattattgggcgtaaagcgcgcgcaggcggtttcttaagtctgatgtgaaagcccccggcttaaccggggagggtcattggaaactgggagacttagagtgcagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatgatacaaagggtcgcgaagccgcgaggtgaagctaatcccataaaatcattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgcatcggaaggtgcggctggatcacctcctttctaaggaa

SEQ ID NO: 5107 - DNA, 1560 bp, Listeria innocua
  ref <308>: DATABASE ACCESSION NUMBER: NCBI ACCESSION: NZ_UAST01000009.1
  ref <309>: DATABASE ENTRY DATE: 2019-04-01
  ref <313>: RELEVANT RESIDUES IN SEQ ID NO: (1)..(1560)
tttaaagagagtttgatcctggctcaggacgaaacgctggcggcgtgcctaatacatgcaagtcgaacgaacggaggaagagcttgctcttccaaagttagtggcggacgggtgagtaacacgtgggcaacctgcctgtaagttggggataactccgggaaaccggggctaataccgaatgatagagtgtggcgcatgccacgctcttgaaagatggtttcggctatcgcttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccacgtgtagcggtgaaatgcgtagatatgtggaggaacaccagtggcgaaaggcgactctctggtctgtaactgacgctgaggcgccgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatggtacaaagggtcgcgaagccgcgaggtggagccaatcccataaaaccattctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtagggtaacctttatggaggccagccgccgaaggtgggacagataattgggtgaagtcgtaacaaggtagccgtatcggaaggtgcggctggatcacctcctttctaaggaa

SEQ ID NO: 5108 - DNA, 1558 bp, Listeria ivanovii
  ref <308>: DATABASE ACCESSION NUMBER: NCBI ACCESSION: NZ_LR134394.1
  ref <309>: DATABASE ENTRY DATE: 2019-04-01
  ref <313>: RELEVANT RESIDUES IN SEQ ID NO: (1)..(1558)
tttaaagagagtttgatcctggctcaggacgaacgctggcggcgtgcctaatacatgcaagtcgaacgaacggaggaagagcttgctcttccaaagttagtggcggacgggtgagtaacacgtgggcaacctgcctgtaagttggggataactccgggaaaccggggctaataccgaatgataagtagtgacgcatgtcatcactttgaaagatggtttcggctatcgcttacagatgggcccgcggtgcattagctagttggtagggtaaaggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcattcagttgggcactctaaagtgactgccggtgcaagccggaggaaggtggggatgacgtcaaatcatcatgccccttatgacctgggctacacacgtgctacaatggatggtacaaagggtagcgaagccgcgaggtggagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtagggtaaccttttaggagccagccgccgaaggtgggacagataattggggtgaagtcgtaacaaggtagccgtatcggaaggtgcggctggatcacctcctttctaaggaa

SEQ ID NO: 5109 - DNA, 1557 bp, Listeria kieliensis
  ref <308>: DATABASE ACCESSION NUMBER: NCBI ACCESSION: NZ_LARY01000007.1
  ref <309>: DATABASE ENTRY DATE: 2019-04-01
  ref <313>: RELEVANT RESIDUES IN SEQ ID NO: (1)..(1557)
tttaaagagagtttgatcctggctcaggacgaacgctggcggcgtgcctaatacatgcaagtcgaacgaaccaaagagaagcttgcttctctgtcggtgagtggcggacgggtgagtaacacgtgggcaacctgcctatcagcgggggataacacttggaaacaggtgctaataccgcataataatgaggttcgcatgaacctcgtttgaaagacggtttcggctgtcactgatagatgggcccgcggtgcattagctagttggtggggtaaaggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggatgaagtaactattcatcccctgacggtatctaaccagaaagccacggctaactacgtgccagcagccgcggtaatacgtaggtggcaagcgttgtccggaattattgggcgtaaagcgcgcgcaggcggtttcttaagtctgatgtgaaagcccccggcttaaccggggagggtcattggaaactgggagactggagtgcagaagaggagagtggaattccatgtgtagcggtgaaatgcgtagatatatggaggaacaccagtggcgaaggcggctctctggtctgtaactgacgctgaggcgcgaaagcgtggggagcaaacaggattagataccctggtagtccacgccgtaaacgatgagtgctaagtgttagggggtttccgccccttagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatggtacaaagggcagcgaagccgtgaggtgaagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtagggtaacctttttggagccagccgccgaaggtgggacagataattggggtgaagtcgtaacaaggtagccgtatcggaaggtgcggctggatcacctcctttctaagga

SEQ ID NO: 5110 - DNA, 1558 bp, Listeria monocytogenes
  ref <308>: DATABASE ACCESSION NUMBER: NCBI ACCESSION: NZ_LR134397.1
  ref <309>: DATABASE ENTRY DATE: 2019-04-01
  ref <313>: RELEVANT RESIDUES IN SEQ ID NO: (1)..(1558)
tttaaagagagtttgatcctggctcaggacgaacgctggcggcgtgcctaatacatgcaagtcgaacgaacggaggaagagcttgctcttccaatgttagtggcggacgggtgagtaacacgtgggcaacctgcctgtaagttggggataactccgggaaaccggggctaataccgaatgataaagtgtggcgcatgccacgcttttgaaagatggtttcggctatcgcttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatagtacaaagggtcgcgaagccgcgaggtggagctaatcccataaaactattctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaaggaa

SEQ ID NO: 5111 - DNA, 1560 bp, Listeria newyorkensis
  ref <308>: DATABASE ACCESSION NUMBER: NCBI ACCESSION: NZ_UAWS01000029.1
  ref <309>: DATABASE ENTRY DATE: 2019-04-01
  ref <313>: RELEVANT RESIDUES IN SEQ ID NO: (1)..(1560)
tttaaagagagtttgatcctggctcaggacgaacgctggcggcgtgcctaatacatgcaagtcgaacgaaccgatgaaagagcttgctctttctgacgttagtggcggacgggtgagtaacacgtgggcaacctgcctgtaagttggggataactccgggaaaccggggctaataccgaataataacaagcgtcgcatgacgcctgtttgaaagatggtttcggctatcacttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgagagacttgaatgcaggagaggtaagtggaattccacgtgtagcggtgaaatgcgtagatatgtggaggaacaccagtggcgaaggcggcttactggcctgtaattgacgctgaggctcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagtggtggagcatgtggtttaattcgaagcaacgcgaagaaccttaccaggtcttgacatcctttgaaccttctggagacagaactttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggataatacaaagggttgccaaaccgcgaggtcgagctaatcccataaaattattctcagttcggattgtaggctgcaactcgcctacatgaagccggaatcactagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaaggaa

SEQ ID NO: 5112 - DNA, 1561 bp, Listeria seeligeri
  ref <308>: DATABASE ACCESSION NUMBER: NCBI ACCESSION: NZ_MJUD01000002.1
  ref <309>: DATABASE ENTRY DATE: 2019-04-01
  ref <313>: RELEVANT RESIDUES IN SEQ ID NO: (1)..(1561)
tattttaaagagagtttgatcctggctcaggacgaacgctggcggcgtgcctaatacatgcaagtcgaacgaacggaggaagagcttgctcttccaaagttagtggcggacgggtgagtaacacgtgggcaacctgcctgtaagttggggataactccgggaaaccggggctaataccgaatgataaggagtgacgcatgtcactgctttgaaagatggtttcggctatcgcttacagatgggcccgcggtgcattagctagttggtagggtaaaggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatggtacaaagggtagcgaagccgcgaggtggagccaatcccataaaaccattctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaaggaa

SEQ ID NO: 5113 - DNA, 1560 bp, Listeria sp. SHR NRA 18
  ref <308>: DATABASE ACCESSION NUMBER: NCBI ACCESSION: NZ_QPKR01000034.1
  ref <309>: DATABASE ENTRY DATE: 2019-04-01
  ref <313>: RELEVANT RESIDUES IN SEQ ID NO: (1)..(1560)
tttaaagagagtttgatcctggctcaggacgaacgctggcggcgtgcctaatacatgcaagtcgaacgaaccgacgaaagagcttgctctttctgacgttagtggcggacgggtgagtaacacgtgggcaacctgcctgtaagttggggataactccgggaaaccggggctaataccgaataataacaagcgtcgcatgacgcctgtttgaaagatggtttcggctatcacttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgagagacttgaatgcaggagaggtaagtggaattccacgtgtagcggtgaaatgcgtagatatgtggaggaacaccagtggcgaaggcggcttactggcctgtaattgacgctgaggctcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagtggtggagcatgtggtttaattcgaagcaacgcgaagaaccttaccaggtcttgacatcctttgaaccttctggagacagaactttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggataatacaaagggttgccaaaccgcgaggtcgagctaatcccataaaattattctcagttcggattgtaggctgcaactcgcctacatgaagccggaatcactagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaaggaa

SEQ ID NO: 5114 - DNA, 1557 bp, Listeria thailandensis
  ref <308>: DATABASE ACCESSION NUMBER: NCBI ACCESSION: NZ_UTAE01000003.1
  ref <309>: DATABASE ENTRY DATE: 2019-04-01
  ref <313>: RELEVANT RESIDUES IN SEQ ID NO: (1)..(1557)
tttaaagagagtttgatcctggctcaggacgaacgctggcggcgtgcctaatacatgcaagtcgaacgaaccaaagagaagcttgcttctctgtcggtgagtggcggacgggtgagtaacacgtgggcaacctgcctatcagcgggggataacacttggaaacaggtgctaataccgcataataatgaggttcgcatgaacctcgtttgaaagacggtttcggctgtcactgatagatgggcccgcggtgcattagctagttggtggggtaaaggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggatgaagtaactattcaccccctgacggtatctaaccagaaagccacggctaactacgtgccagcagccgcggtaatacgtaggtggcaagcgttgtccggaattattgggcgtaaagcgcgcgcaggcggtttcttaagtctgatgtgaaagcccccggcttaaccggggagggtcattggaaactgggagactggagtgcagaagaggagagtggaattccatgtgtagcggtgaaatgcgtagatatatggaggaacaccagtggcgaaggcggctctctggtctgtaactgacgctgaggcgcgaaagcgtggggagcaaacaggattagataccctggtagtccacgccgtaaacgatgagtgctaagtgttagggggtttccgccccttagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggatggtacaaagggcagcgaagccgtgaggtgaagccaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtagggtaacctttttggagccagccgccgaaggtgggacagataattggggtgaagtcgtaacaaggtagccgtatcggaaggtgcggctggatcacctcctttctaagga

SEQ ID NO: 5115 - DNA, 1562 bp, Listeria weihenstephanensis
  ref <308>: DATABASE ACCESSION NUMBER: NCBI ACCESSION: NZ_AODJ01000064.1
  ref <309>: DATABASE ENTRY DATE: 2019-04-01
  ref <313>: RELEVANT RESIDUES IN SEQ ID NO: (1)..(1562)
attttaaagagagtttgatcctggctcaggacgaacgctggcggcgtgcctaatacatgcaagtcgaacgaaccgaagaaagagcttgctctttccgacgttagtggcggacgggtgagtaacacgtgggcaacctgcctgtaagttggggataactccgggaaaccggggctaataccgaatgataacaagcgtcgcatgacgcctgtttgaaagatggtttcggctatcgcttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgagagacttgaatgcaggagaggtaagtggaattccacgtgtagcggtgaaatgcgtagatatgtggaggaacaccagtggcgaaggcggcttactggcctgtaattgacgctgaggctcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagtggtggagcatgtggtttaattcgaagcaacgcgaagaaccttaccaggtcttgacatcctttgaccattctggagacagaactttcccttcggggacaaagtgacaggtggtgcatggttgtcgtcagctcgtgtcgtgagatgttgggttaagtcccgcaacgagcgcaacccttaattttagttgccagcatttagttgggcactctaaagtgactgccggtgcaagccggaggaaggtggggatgacgtcaaatcatcatgccccttatgacctgggctacacacgtgctacaatggataatacaaagggttgccaaaccgcgaggtcgagctaatcccataaaattattctcagttcggattgtaggctgcaactcgcctacatgaagccggaatcactagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaaggaa

SEQ ID NO: 5116 - DNA, 1561 bp, Listeria welshimeri
  ref <308>: DATABASE ACCESSION NUMBER: NCBI ACCESSION: NZ_LT906444.1
  ref <309>: DATABASE ENTRY DATE: 2019-04-01
  ref <313>: RELEVANT RESIDUES IN SEQ ID NO: (1)..(1561)
tattttaaagagagtttgatcctggctcaggacgaacgctggcggcgtgcctaatacatgcaagtcgaacgaacggaggaagagcttgctcttccaaagttagtggcggacgggtgagtaacacgtgggcaacctgcctgtaagttggggataactccgggaaaccggggctaataccgaataataagtggtggcgcatgccacggctttgaaagatggtttcggctatcgcttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtatgaagaaggttttcggatcgtaaagtactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgcgcgcaggcggtcttttaagtctgatgtgaaagcccccggcttaaccggggagggtcattggaaactggaagactggagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctggagacagagctttcccttcggggacaaagtgacaggtggtgcatggttgtcgtcagctcgtgtcgtgagatgttgggttaagtcccgcaacgagcgcaacccttaattttagttgccagcatttagttgggcactctaaagtgactgccggtgcaagccggaggaaggtggggatgacgtcaaatcatcatgccccttatgacctgggctacacacgtgctacaatggatggtacaaagggtcgcgaagccgcgaggtggagccaatcccataaaaccattctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaaggaa

SEQ ID NO: 5117 - DNA, 1446 bp, Listeriaceae bacterium FSL A5-0209
  ref <308>: DATABASE ACCESSION NUMBER: NCBI ACCESSION: NZ_JNEZ01000029.1
  ref <309>: DATABASE ENTRY DATE: 2019-04-01
  ref <313>: RELEVANT RESIDUES IN SEQ ID NO: (1)..(1446)
gagtaacacgtgggcaacctgcctgtaagttggggataactccgggaaaccggggctaataccgaataataacaagcgtcgcatgacgcctgtttgaaagatggtttcggctatcacttacagatgggcccgcggtgcattagctagttggtagggtaatggcctaccaaggcaacgatgcatagccgacctgagagggtgatcggccacactgggactgagacacggcccagactcctacgggaggcagcagtagggaatcttccgcaatggacgaaagtctgacggagcaacgccgcgtgtgtgaagaaggttttcggatcgtaaagcactgttgttagagaagaacaaggataagagtaactgcttgtcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgagagacttgaatgcaggagaggtaagtggaattccacgtgtagcggtgaaatgcgtagatatgtggaggaacaccagtggcgaaggcggcttactggcctgtaattgacgctgaggctcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagtggtggagcatgtggtttaattcgaagcaacgcgaagaaccttaccaggtcttgacatcctttgaaccttctggagacagaactttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgcaagccggaggaaggtggggatgacgtcaaatcatcatgccccttatgacctgggctacacacgtgctacaatggataatacaaagggttgccaaaccgcgaggtcgagctaatcccataaaattattctcagttcggattgtaggctgcaactcgcctacatgaagccggaatcactagtaatcgtggatcagcatgccacggtgaatacgttcccgggccttgtacacaccgcccgtcacaccacgagagtttgtaacacccgaagtcggtagggtaacctttatggagccagccgccgaaggtgggacagataattggggtgaagtcgtaacaaggtagccgtatcggaaggtgcggctggatcacctcctttctaaggaa

SEQ ID NO: 5118 - DNA, 1470 bp, Litoreibacter arenae
  ref <308>: DATABASE ACCESSION NUMBER: NCBI ACCESSION: NZ_KE557314.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgcaccttcgggtgagcggcggacgggttagtaacgcgtgggaacatacccttctctaaggaatagtctcgggaaactgggggtaataccttataagcccttcgggggaaagatttatcggtgaaggattggcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattagcaagttaggggtgaaatcccggggctcaaccccggaactgcccttaaaactgttagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcatcgagatttctggagacagatttcgtcagttcggctggatgagtgacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttccacctgacggccgtgcgctaacccttcggggaggcagcggaccacggtgagatcagcgactggggtgaagtcgtaacaaggtagccgtaggggaacctgcggctggatcacctcctttcta

SEQ ID NO: 5119 - DNA, 1474 bp, Litoreibacter ascidiaceicola
  ref <308>: DATABASE ACCESSION NUMBER: NCBI ACCESSION: NZ_FQUV01000019.1
  ref <309>: DATABASE ENTRY DATE: 2019-04-01
  ref <313>: RELEVANT RESIDUES IN SEQ ID NO: (1)..(1474)
tcaacttgagagtttgatcctggctcagaacgaacgctggcggcaggcctaacacatgcaagtcgagcgcaccttcgggtgagcggcggacgggttagtaacgcgtgggaatatacccaaaggtacggaatagcctcgggaaactgagagtaataccgtatgtgcccttcgggggaaagatttatcgcctttggattagcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattagtcagtcagaggtgaaatcccagggctcaaccctggaactgcctttgatactgctagtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgtgtatcgagatttctggagacagatttcgtcagttcggctggatacaacacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaagg

SEQ ID NO: 5120 - DNA, 1471 bp, Litoreibacter meonggei
  ref <308>: DATABASE ACCESSION NUMBER: NCBI ACCESSION: NZ_RCCE01000003.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgcaccttcgggtgagcggcggacgggttagtaacgcgtgggaacatacccttttctacggaatagcctcgggaaactgagagtaataccgtatacgcccttcgggggaaagatttatcggtgaaggattggcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattagtcagtcagaggtgaaatcccagggctcaaccctggaactgcctttgatactgctagtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcatcgcggttaccagagatggtttccttcagttcggctggatgagtgacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 5121 - DNA, 1468 bp, Litoreibacter ponti
  ref <308>: DATABASE ACCESSION NUMBER: NCBI ACCESSION: NZ_QBKS01000002.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgagcgcaccttcgggtgagcggcggacgggttagtaacgcgtgggaatatgcccaaaggtacggaatagcctctggaaacggagagtaataccgtatgtgcccttcgggggaaagatttatcgcctttggattagcccgcgttggattaggtagttggtggggtaatggcctaccaagcctacgatccatagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagggatgataatgacagtacctggtaaagaaaccccggctaactccgtgccagcagccgcggtaatacggagggggttagcgttgttcggaattactgggcgtaaagcgtacgtaggcggattagtcagtcagaggtgaaatcccagggctcaaccctggaactgcctttgatactgctagtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccggagacggtttccttcagttcggctggatcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 5122 - DNA, 1483 bp, Litorimonas taeanensis
  ref <308>: DATABASE ACCESSION NUMBER: NCBI ACCESSION: NZ_RBII01000002.1
  ref <309>: DATABASE ENTRY DATE: 2019-04-01
  ref <313>: RELEVANT RESIDUES IN SEQ ID NO: (1)..(1483)
caacctgagagtttgattctggctcagaacgaacgctggcggcgtgcttaacacattcaagtcgaacgagaaattaccttcgggtaatggacagtggcagacgggtgagtaacgcgtggcaacctacccttcactacgggacaacagttggaaacgactgctaataccgtatacgtcctccgggagaaagatttatcggtgatggatggggccgcgttagattagcttgttggtggggtaatggcctaccaaggcgacgatctatagctggtctgagaggatgatcagccacactgggactgagacacggcccagactcctacgggaggcagcagtggggaatattggacaatgggcgcaagcctgatccagcaacgccgcgtgaatgatgaaggccttagggttgtaaaattctttcgctagggaagataatgactgtacctagtaaagaagccccggctaactccgtgccagcagccgcggtaatacggagggggctagcgttgttcggaattactgggcgtaaagcgtgcgtaggcggattaataagttagatgtgaaatcccagggctcaaccctggaactgcatttaaaactgttagtcttgagttctggagaggtaagtggaattcctagtgtagaggtgaaattcgtagatattaggaggaacaccagaggcgaaggcggcttactggacagatactgacgctgaggcacgaaagtgtggggagcaaacaggattagataccctggtagtccacaccgtaaacgatgagagctagttgtctgcaagcatgcttgtaggtgacgcagctaacgcattaagctctccgcctggggagtacggtcgcaagattaaaactcaaagaaattgacgggggcccgcacaagcggtggagcatgtggtttaattcgaagcaacgcgcagaaccttacctacccttgacatgccggtcgcgatttccagagatggatttcttcaattcggttggaccgtgcacaggtgctgcatggctgtcgtcagctcgtgtcgtgagatgttgggttaagtcccgcaacgagcgcaaccctcatctttagttgccagcatttagttgggcactctagagaaactgccggtgctaagccggaggaaggtggggatgacgtcaagtcctcatggcccttacgggtagggctacacacgtgctacaatggcgctgacagagggttaatccctaaaaggcgtctcagttcggattgtcttctgcaactcgaagacatgaagttggaatcgctagtaatcgtggatcagcatgccacggtgaatacgttcccgggccttgtacacaccgcccgtcacaccatgggagttggttctacccgaaggtggtgcgctaacctgcttgcaggaggcagccaaccacggtagggtcagcgactggggtgaagtcgtaacaaggtagccgtaggggaacctgcggctggatcacctcctttctaa

SEQ ID NO: 5123 - DNA, 1467 bp, Loktanella atrilutea
  ref <308>: DATABASE ACCESSION NUMBER: NCBI ACCESSION: NZ_FQUE01000034.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcacgcctaacacatgcaagtcgagcgagatcttcggatctagcggcggacgggttagtaacgcgtgggaacgtaccttttgcttcggaatagcctcgggaaactgggagtaataccgaatgtgccctttgggggaaagatttatcggcaaaggatcggcccgcgtctgattagatagttggtggggtaatggcctaccaagtctgcgatcagtagctggtttgagaggatgatcagcaacactgggactgagacacggcccagactcctacgggaggcagcagtggggaatcttagacaatgggcgcaagcctgatctagcgatgccgcgtgagtgacgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggaccatcaagttgggggtgaaatcccggggctcaaccccggaactgcctccaaaactgctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctctgaccgcccgggagaccgggttttatcgtaagatacagagtgacaggtgctgcatggctgtcgtcagctcgtgtcgtgagatgttcggttaagtccggcaacgagcgcaacccacatcctcagttgccatcatttggttgggcactctggggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaacccttcgggggggcagcggaccacggtaggatcagcgactggggtgaagtcgtaacaaggtagccgtaggggaacctgcggctggatcacctcctttcta

SEQ ID NO: 5124 - DNA, 1468 bp, Loktanella sp. 1ANDIMAR09
  ref <308>: DATABASE ACCESSION NUMBER: NCBI ACCESSION: NZ_LIGP01000013.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgagcgcactcttcggagtgagcggcggacgggttagtaacgcgtgggaacatacccttttctacggaatagcctcgggaaactgagagtaataccgtatacgcccttcgggggaaagatttatcggagaaggattggcccgcgtttgattagatagttggtggggtaatggcctaccaagtctacgatcaatagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattggaaagtagggggtgaaatcccagggctcaaccctggaactgcctcctaaactatcagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccggcagagagatctgttttccacttcggtggccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 5125 - DNA, 1467 bp, Loktanella sp. 22II-4b; identical to SEQ ID NO: 2156
  ref <308>: DATABASE ACCESSION NUMBER: NCBI ACCESSION: NZ_AQQT01000020.1
  ref <309>: DATABASE ENTRY DATE: 2019-04-01
  ref <313>: RELEVANT RESIDUES IN SEQ ID NO: (1)..(1467)

SEQ ID NO: 5126 - DNA, 1467 bp, Loktanella sp. 3ANDIMAR09
  ref <308>: DATABASE ACCESSION NUMBER: NCBI ACCESSION: NZ_LJAK01000027.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcacgcctaacacatgcaagtcgagcgagaccttcgggtctagcggcggacgggttagtaacgcgtgggaacgtacccttttctacggaatagcctcgggaaactgggagtaataccgtatacgcccttttggggaaagatttatcggtgaaggatcggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagcgatgccgcgtgtgtgacgaaggccttagggtcgtaaagcactttcgccagggatgataatgacagtacctggtaaagaaaccccggctaactccgtgccagcagccgcggtaatacggagggggttagcgttgttcggaattactgggcgtaaagcgcacgtaggcggatcagaaagttgggggtgaaatcccggggctcaaccccggaactgcctccaaaactattggtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctctgaccgactgggagaccagtttttatcgtaagatacagagtgacaggtgctgcatggctgtcgtcagctcgtgtcgtgagatgttcggttaagtccggcaacgagcgcaacccacatccttagttgccagcattcagttgggcactctagggaaactgcccgtgataagcgggaggaaggtgtggatgacgtcaagtcctcatggcccttacgggttgggctacacacgtgctacaatggtgcatacaatgggttaatccctaaaatgcatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaacccttacgggaggcagcggaccacggtaggatcagcgactggggtgaagtcgtaacaaggtagccgtaggggaacctgcggctggatcacctcctttcta

SEQ ID NO: 5127 - DNA, 1468 bp, Loktanella sp. 5RATIMAR09; identical to SEQ ID NO: 5124
  ref <308>: DATABASE ACCESSION NUMBER: NCBI ACCESSION: NZ_LJAL01000022.1
  ref <309>: DATABASE ENTRY DATE: 2019-04-01
  ref <313>: RELEVANT RESIDUES IN SEQ ID NO: (1)..(1468)

SEQ ID NO: 5128 - DNA, 1469 bp, Loktanella sp. Alg231-35
  ref <308>: DATABASE ACCESSION NUMBER: NCBI ACCESSION: NZ_FREV01000002.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcactcttcggagtgagcggcggacgggttagtaacgcgtgggaacatacccttctctacggaatagcctcgggaaactgagagtaataccgtatacgcccttcgggggaaagatttatcggagatggattggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgaaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattggaaagtagggggtgaaatcccagggctcaaccctggaactgcctcctaaactatcagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatctggttttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 5129 - DNA, 1471 bp, Loktanella sp. D2R18
  ref <308>: DATABASE ACCESSION NUMBER: NCBI ACCESSION: NZ_QOCG01000027.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgcttcacttcggtgaggagcggcggacgggttagtaacgcgtgggaatatacccttcactatggaatagcctcgggaaactgagagtaataccatatacgcccttcgggggaaagatttatcggtgaaggattagcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattggaaagtagggggtgaaatcccagggctcaaccctggaactgcctcctaaactatcagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatctggttttctcgtaagagacctagtgacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagttggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 5130 - DNA, 1468 bp, Loktanella sp. IMCC34160
  ref <308>: DATABASE ACCESSION NUMBER: NCBI ACCESSION: NZ_SELP01000013.1
  ref <309>: DATABASE ENTRY DATE: 2019-04-01
  ref <313>: RELEVANT RESIDUES IN SEQ ID NO: (1)..(1468)
tcaacttgagagtttgatcctggctcagaacgaacgctggcggcaggcctaacacatgcaagtcgagcgctctcttcggagggagcggcggacgggtgagtaacgcgtgggaacgtgcccttctctgcggaatagcctttggaaacgaagagtaataccgcatacgccctttgggggaaagatttatcggagaaggatcggcccgcgttggattaggtagttggtggggtaatggcctaccaagcctacgatccatagctggtttgagaggatgatcagccacactgggactgagacacggcccagactcctacgggaggcagcagtggggaatcttagacaatgggggcaaccctgatctagccatgccgcgtgagtgacgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggatcagaaagttgggggtgaaatcccggggctcaaccccggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggggagcttgctcttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgggaccgctggagagatccagtttccacttcggtggctcggtgacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaaggcggtgcgccaacctttcgagggggcagccgaccacggtaggctcagcgactggggtgaagtcgtaacaaggtagccgtaggggaacctgcggctggatcacctcctttctaa

SEQ ID NO: 5131 - DNA, 1468 bp, Loktanella sp. PT4BL
  ref <308>: DATABASE ACCESSION NUMBER: NCBI ACCESSION: NZ_QJJL01000023.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgagcgcactcttcggagtgagcggcggacgggttagtaacgcgtgggaacatacccttttctacggaatagcctcgggaaactgagagtaataccgtatacgcccttcgggggaaagatttatcggagaaggattggcccgcgtttgattagatagttggtggggtaatggcctaccaagtctacgatcaatagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattagaaagtagggggtgaaatcccagggctcaaccctggaactgcctcctaaactactagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccggcagagagatctgttttccacttcggtggccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccgtaagggaggcaggcggccacggtaggatcagcgactggggtgaagtcgtaacaaggtagccgtaggggaacctgcggctggatcacctcctttctaa

SEQ ID NO: 5132 - DNA, 1467 bp, Loktanella sp. S4079
  ref <308>: DATABASE ACCESSION NUMBER: NCBI ACCESSION: NZ_JXYE01000009.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcactcttcggagtgagcggcggacgggttagtaacgcgtgggaatatacccttcactacggaatagcctttggaaacgaagagtaataccgtatacgccctttgggggaaagatttatcggtgaaggattagcccgcgtctgattagatagttggtggggtaacggcctaccaagtctacgatcagtagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatctggttttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttctaa

SEQ ID NO: 5133 - DNA, 1546 bp, Lonsdalea britannica
  ref <308>: DATABASE ACCESSION NUMBER: NCBI ACCESSION: NZ_CP023009.1
  ref <309>: DATABASE ENTRY DATE: 2019-04-01
  ref <313>: RELEVANT RESIDUES IN SEQ ID NO: (1)..(1546)
ttaattgaagagtttgatcatggctcagattgaacgctggcggcaggcctaacacatgcaagtcgagcggcagcggaaagtagcttgctactttgccggcgagcggcggacgggtgagtaatgtctggggatctgcccgatggagggggataactactggaaacggtagctaataccgcataacgtcgcaagaccaaagtgggggaccttcgggcctcacaccatcggatgaacccagatgggattagctagtaggcggggtaaaggcccacctaggcgacgatctctagctggtctgagaggatgaccagccacactggaactgagacacggtccagactcctacgggaggcagcagtggggaatattgcacaatgggggaaaccctgatgcagccatgccgcgtgtatgaagaaggccttcgggttgtaaagtactttcagcggggaggaagggagtaaggttaatagccttattcattgacgttacccgcagaagaagcaccggctaactccgtgccagcagccgcggtaatacggagggtgcaagcgttaatcggaatgactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgcggtcttgaactgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacataatggtgggaactcaaaggagactgccggtgataaaccggaggaaggtggggatgacgtcaagtcatcatggcccttacgagtagggctacacacgtgctacaatggcgcatacaaagagaagcgaacttgcgagagtaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 5134 - DNA, 1547 bp, Lonsdalea iberica
  ref <308>: DATABASE ACCESSION NUMBER: NCBI ACCESSION: NZ_LUTQ01000107.1
  ref <309>: DATABASE ENTRY DATE: 2019-04-01
  ref <313>: RELEVANT RESIDUES IN SEQ ID NO: (1)..(1547)
tttaattgaagagtttgatcatggctcagattgaacgctggcggcaggcctaacacatgcaagtcgagcggcagcggaaggaagcttgcttccttgccggcgagcggcggacgggtgagtaatgtctggggatctgcctgatggagggggataactactggaaacggtagctaataccgcataacgtcgcaagaccaaagtgggggaccttcgggcctcacaccatcggatgaacccagatgggattagctagtaggcggggtaaaggcccacctaggcgacgatctctagctggtctgagaggatgaccagccacactggaactgagacacggtccagactcctacgggaggcagcagtggggaatattgcacaatgggggaaaccctgatgcagccatgccgcgtgtatgaagaaggccttcgggttgtaaagtactttcagcggggaggaaggcagtgaacttaatacgttcgctgattgacgttacccgcagaagaagcaccggctaactccgtgccagcagccgcggtaatacggagggtgcaagcgttaatcggaatgactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgcggtcttgaactgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttggcagagatgccttggtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgcatacaaagagaagcgaacttgcgagagtaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 5135 - DNA, 1546 bp, Lonsdalea populi
  ref <308>: DATABASE ACCESSION NUMBER: NCBI ACCESSION: NZ_RJUJ01000033.1
  ref <309>: DATABASE ENTRY DATE: 2019-04-01
  ref <313>: RELEVANT RESIDUES IN SEQ ID NO: (1)..(1546)
ttaattgaagagtttgatcatggctcagattgaacgctggcggcaggcctaacacatgcaagtcgagcggcagcggaagggagcttgctcccttgccggcgagcggcggacgggtgagtaatgtctggggatctgcccgatggagggggataactactggaaacggtagctaataccgcataacgtcgcaagaccaaagtgggggaccttagggcctcacaccatcggatgaacccagatgggattagctagtaggcggggtaagagcccacctaggcgacgatctctagctggtctgagaggatgaccagccacactggaactgagacacggtccagactcctacgggaggcagcagtggggaatattgcacaatgggggaaaccctgatgcagccatgccgcgtgtatgaagaaggccttcgggttgtaaagtactttcagcggggaggaaggcagtgaacttaatacgttcgctgattgacgttacccgcagaagaagcaccggctaactccgtgccagcagccgcggtaatacggagggtgcaagcgttaatcggaatgactgggcgtaaagcgcacgcaggcggtttgttaagtcagatgtgaaatccccgagcttaacttgggaactgcatttgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgcggtcttgaactgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttggcagagatgccttggtgccttcgggagctctgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcgcatacaaagagaagcgaacttgcgagagtaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 5136 - DNA, 1360 bp, Lucifera butyrica
  ref <308>: DATABASE ACCESSION NUMBER: NCBI ACCESSION: NZ_UPPP01000001.1
  ref <309>: DATABASE ENTRY DATE: 2019-04-01
  ref <313>: RELEVANT RESIDUES IN SEQ ID NO: (1)..(1360)
attattggagagtttgatcctggctcaggacgaacgctggcggcgtgcctaacacatgcaagtcgaacggaggtttcagcaatggaaccttagtggcgaacgggtgagtaacgcgtagacaacctgccttttagttggggacaacacctcgaaaggggtgctaataccgaatgagcagtccgtgccgcatggcaaggacaggaaagacggcctctgaacatgctgtcgctaaaagaagggtctgcgtctgattagctggttggtgaggtaagagctcaccaaggcgacgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggatcgtaaagctctgtcttttggggcgaacgtaggataggtgaatagtctatcgtagtgacggtaccaaaggaggaagccacggctaactacgtgccagcagccgcggtaatacgtaggtggcgagcgttgtccggaatgattgggcgtaaagggcgcgtaggcgggatactgtgtctatcttaaaagtgcggggctcaaccccgtgagggggtagaaactggtattcttgagtgcaggagaggaaagtggaattcccagtgtagcggtgaaatgcgtagagattgggaggaacaccagtggcgaaggcgactttctggactgtgtctgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccagggcttgacatcgtctgaagactctagagatagagagagctccttcgggagacagatagacaggtggtgcatggctgtcgtcagctcgtgtcgtgagatgttgggttaagtcccgcaacgagcgcaacccctatcctttgttgccagcatgtaaagatgggaactcaaaggagactgccgcagagaatgcggaggaaggcggggatgacgtcaagtcatcatgccccttatgtcctgggctacacacgtactacaatgggcttaaacagagggaagcgaagccgcgaggtgaagcaaaccccacaaaggagctctcagttcggatcgcaggctgcaactcgcctgcgtgaagtcggaatcgctag

SEQ ID NO: 5137 - DNA, 1527 bp, Lunatimonas lonarensis
  ref <308>: DATABASE ACCESSION NUMBER: NCBI ACCESSION: NZ_AQHR01000033.1
  ref <309>: DATABASE ENTRY DATE: 2019-04-01
  ref <313>: RELEVANT RESIDUES IN SEQ ID NO: (1)..(1527)
tttacaatggagagtttgatcctggctcaggatgaacgctagcggcaggcctaatacatgcaagtcgtacggcagggttttcttcgggaagcccgagagtggcgcacgggtgcgtaacgcgtatgcaacctgccccgtactgggggatagcccggggaaacccggattaataccccatgggacgttgacatggcatcatgttgacgttaaagatttattggtacgggatgggcatgcgtaggattagctggttggcggggtaacggcccaccaaggctacgatccttaggggttctgagaggaaggtcccccacactggcactgagatacgggccagactcctacgggaggcagcagtagggaatattgggcaatgggcggaagcctgacccagccatgccgcgtgcaggaagacggcctattgggttgtaaactgcttttatacgggaagaaaaggcccatgcgtgggacattgccggtaccgtatgaataagcaccggctaactccgtgccagcagccgcggtaatacggagggtgcgagcgttgtccggatttattgggtttaaagggtgcgtaggcggctttttaagtcagcggtgaaagttttcggctcaaccggaaaaatgccgttgatactggggggcttgagtcacggaggggtacatggaattggtggtgtagcggtgaaatgcatagataccatcaggaacaccgatagcgtaggcattgtgcttgccgtgaactgacgctgaggcacgaaagcgtgggtagcgaacaggattagataccctggtagtccacgccgtaaacgatggtcactcgctgtcatgcccatgaggtgtggcggccaagcgaaagcgttaagtgacccacctggggagtacgcccgcaagggtgaaactcaaaggaattgacgggggtccgcacaagcggtggagcatgtggtttaattcgatgatacgcgaggaaccttacccgggctagaatgtgaccgaagcgaccagagatggtcgcgtccgcaaggacgggaaacaaggtgctgcatggctgtcgtcagctcgtgccgtgaggtgttgggttaagtcccgcaacgagcgcaacccctgttgtcagttgccatcgggtagagccggggactctgacaagactgcccgcgcaagcggagaggaaggaggggacgacgtcaagtcatcatggcccttacgcccggggcgacacacgtgctacaatggcgcatacagcgggtagctaccctgcaaggggatgccaacctctaaaagtgcgtctcagttcggatcggggtctgcaacccgaccccgtgaagctggaatcgctagtaatcgcgcatcagccatggcgcggtgaatacgttcccggaccttgtacacaccgcccgtcaagccatggaagtcgggtagacctgaaggcggtaaccgcgaggagccgtttagggtagaaccggtaactggggctaagtcgtaacaaggtagccgtaccggaaggtgcggctggaacacctcctttct

SEQ ID NO: 5138 - DNA, 1548 bp, Luteimonas sp. 4-12
  ref <308>: DATABASE ACCESSION NUMBER: NCBI ACCESSION: NZ_NRQR01000006.1
  ref <309>: DATABASE ENTRY DATE: 2019-04-01
  ref <313>: RELEVANT RESIDUES IN SEQ ID NO: (1)..(1548)
taagtgaagagtttgatcctggctcagagtgaacgctggcggcaggcctaacacatgcaagtcgaacggcagcacaggagagcttgctctctgggtggcgagtggcggacgggtgaggaatacatcggaatctgcctatttgtgggggataacgtagggaaacttacgctaataccgcatacgacctacgggtgaaagcggaggaccttcgggcttcgcgcagatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggtttgttaagtctgatgtgaaagccctgggctcaacctgggaattgcattggatactggcaggctagagtgcggtagaggatggcggaattcccggtgtagcagtgaaatgcgtagagatcgggaggaacatccgtggcgaaggcggccatctggaccagcactgacactgaggcacgaaagcgtggggagcaaacaggattagataccctggtagtccacgccctaaacgatgcgaactggatgttgggttcaactaggaactcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaaacccgcgagggcaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcctaaccgcaaggggggcgcttgccacggtgtggccgatgactggggtgaagtcgtaacaaggtagccgtatcggaaggtgcggctggatcacctcctttaga

SEQ ID NO: 5139 - DNA, 1526 bp, Lutibacter agarilyticus
  ref <308>: DATABASE ACCESSION NUMBER: NCBI ACCESSION: NZ_FZNT01000017.1
  ref <309>: DATABASE ENTRY DATE: 2019-04-01
  ref <313>: RELEVANT RESIDUES IN SEQ ID NO: (1)..(1526)
tacgatggagagtttgatcctggctcaggatgaacgctagcggcaggcttaacacatgcaagtcgaggggtaacagaagtagcttgctatttgctgacgaccggcgcacgggtgcgtaacgcgtatacaatctaccttttacagaggaatagcccagagaaatttggattaatacctcatagtattataaagtggcatcatttaataattaaaacttcggtggtaaaagatgagtatgcgttctattagctagatggtaaggtaacggcttaccatggcaacgatagataggggtcctgagagggagatcccccacactggtactgagacacggaccagactcctacgggaggcagcagtgaggaatattggacaatggaggtaactctgatccagccatgccgcgtgcaggaagacggccctatgggttgtaaactgcttttatataggaagaaaccgttccacgtgtggaactctgacggtactatatgaataagcaccggctaactccgtgccagcagccgcggtaatacggagggtgcaagcgttatccggaatcattgggtttaaagggtccgtaggcgggctaataagtcaggggtgaaataccacagctcaactgtggaactgcctttgatactgttagtcttgaattatatggaagtagatagaatgtgtagtgtagcggtgaaatgcttagagattacacagaataccgattgcgaaggcagtctactacgtatatattgacgctaatggacgaaagcgtggggagcgaacaggattagataccctggtagtccacgccgtaaacgatggacactagttgttggggtaactcagtgactaagcgaaagtgataagtgtcccacctggggagtacgatcgcaagattgaaactcaaaggaattgacgggggcccgcacaagcggtggagcatgtggtttaattcgatgatacgcgaggaaccttaccagggcttaaatgtaggttgcattagctagagatagctatttcttcggactacttacaaggtgctgcatggttgtcgtcagctcgtgccgtgaggtgtcaggttaagtcctataacgagcgcaacccttgtcgttagttgccagcatttcaagatggggactctaacgagactgccggtgcaaaccgagaggaaggtggggatgacgtcaaatcatcacggcccttacgtcctgggctacacacgtgctacaatggtatggacagagagcagccactgagtgatcaggagcgaatctacaaaccatatcacagttcggatcggagtctgcaactcgactccgtgaagctggaatcgctagtaatcgcatatcagccatgatgcggtgaatacgttcccgggccttgtacacaccgcccgtcaagccatggaagctgggggtacctgaagtcggtcaccgcaaggagccgcctagggtaaaactagtaactagggctaagtcgtaacaaggtagccgtaccggaaggtgcggctggaacacctcctttctaga

SEQ ID NO: 5140 - DNA, 1528 bp, Lutibacter oceani
  ref <308>: DATABASE ACCESSION NUMBER: NCBI ACCESSION: NZ_QUOZ01000010.1
  ref <309>: DATABASE ENTRY DATE: 2019-04-01
  ref <313>: RELEVANT RESIDUES IN SEQ ID NO: (1)..(1528)
tacgatggagagtttgatcctggctcaggatgaacgctagcggcaggcttaacacatgcaagtcgaggggtaacaggaaatagcttgctattttgctgacgaccggcgcacgggtgcgtaacgcgtatagaacctaccttttacaggggaatagcccagagaaatttggattaatgccccatagtattattgaatggcatcatttaataattaaacatttatgggtaaaagatggctatgcgttctattagctagatggtaaggtaacggcttaccatggcaacgatagataggggtcctgagagggagatcccccacactggtactgagacacggaccagactcctacgggaggcagcagtgaggaatattggacaatggaggcaactctgatccagccatgccgcgtgcaggaagacggccctatgggttgtaaactgcttttatataggaagaaacctttccacgtgtggagagctgacggtactataagaataagcaccggctaactccgtgccagcagccgcggtaatacggagggtgcaagcgttatccggaatcattgggtttaaagggtccgtaggcggactaataagtcaggggtgaaatcccacagcttaactgtggaactgcctttgatactgttagtcttgaattatatggaagtagatagaatgtgtagtgtagcggtgaaatgcttagagattacacagaataccgattgcgaaggcagtctactacgtatatattgacgctaatggacgaaagcgtggggagcgaacaggattagataccctggtagtccacgccgtaaacgatggacactagttgttggagtaattcagtgactaagcgaaagtgataagtgtcccacctggggagtacgaacgcaagtttgaaactcaaaggaattgacgggggcccgcacaagcggtggagcatgtggtttaattcgatgatacgcgaggaaccttaccagggcttaaatgtaggttgcattagctagagatagctatttcttcggactacttacaaggtgctgcatggttgtcgtcagctcgtgccgtgaggtgtcaggttaagtcctataacgagcgcaacccttgtcgttagttgccagcatttaaagatggggactctaacgagactgccggtgcaaaccgagaggaaggtggggatgacgtcaaatcatcacggcccttacgtcctgggctacacacgtgctacaatggtatggacagagagcagccactgggtgaccaggagcgaatctacaaaccatatcacagttcggatcggagtctgcaactcgactccgtgaagctggaatcgctagtaatcgcatatcagccatgatgcggtgaatacgttcccgggccttgtacacaccgcccgtcaagccatggaagctgggggtacctgaagtcggtcaccgcaaggagccgcctagggtaaaactagtaactagggctaagtcgtaacaaggtagccgtaccggaaggtgcggctggaacacctcctttctaga

SEQ ID NO: 5141 - DNA, 1517 bp, Lutibacter sp. HS1-25
  ref <308>: DATABASE ACCESSION NUMBER: NCBI ACCESSION: NZ_RHLN01000020.1
  ref <309>: DATABASE ENTRY DATE: 2019-04-01
  ref <313>: RELEVANT RESIDUES IN SEQ ID NO: (1)..(1517)
tacgatgaagagtttgatcctggctcaggatgaacgctagcggcaggcttaacacatgcaagtcgaggggcagcacgtcttcggatggtggcgaccggcgcacgggtgcgtaacgcgtatagaacctaccttttacagagggatagcccagagaaatttggattaatacctcatagtattataaagtggcatcatttaataattaaaacttcggtggtaaaagatggctatgcgttctattagctagtaggtaaggtaacggcttacctaggcaacgatagataggggtcctgagagggagatcccccacactggtactgagacacggaccagactcctacgggaggcagcagtgaggaatattggacaatggaggcaactctgatccagccatgccgcgtgcaggaagacggtcctatggattgtaaactgcttttatacaggaagaaacactctctcgtgagggagcttgacggtactgtatgaataagcaccggctaactccgtgccagcagccgcggtaatacggagggtgcaagcgttatccggaatcattgggtttaaagggtccgtaggcggactgataagtcaggggtgaaatccaacagctcaactgttgaattgcctttgatactgttagtcttgaattatatggaagtagatagaatgtgtagtgtagcggtgaaatgcttagagattacacagaataccgattgcgaaggcagtctactacgtatatattgacgctaatggacgaaagcgtggggagcgaacaggattagataccctggtagtccacgccgtaaacgatggacactagttgttggagtaattcagtgactaagcgaaagtgataagtgtcccacctggggagtacgaacgcaagtttgaaactcaaaggaattgacgggggcccgcacaagcggtggagcatgtggtttaattcgatgatacgcgaggaaccttaccagggcttaaatgtaggttgcattagctagagatagctatttcttcggactacttacaaggtgctgcatggttgtcgtcagctcgtgccgtgaggtgtcaggttaagtcctataacgagcgcaacccctgtcgttagttgccatcaagtaaagttggggactctaacgagactgccggtgcaaaccgcgaggaaggtggggatgacgtcaaatcatcacggcccttacgtcctgggctacacacgtgctacaatggtatggacagagagcagccactgggtgaccaggagcgaatctacaaaccatatcacagttcggatcggagtctgcaactcgactccgtgaagctggaatcgctagtaatcgcatatcagccatgatgcggtgaatacgttcccgggccttgtacacaccgcccgtcaagccatggaagctgggggtacctgaagtcggtcaccgcaaggagccgcctagggtaaaactagtaactagggctaagtcgtaacaaggtagccgtaccggaaggtgcggctggaacacctcctttct

SEQ ID NO: 5142 - DNA, 1497 bp, Lutibaculum baratangense
  ref <308>: DATABASE ACCESSION NUMBER: NCBI ACCESSION: NZ_AWXZ01000027.1
  ref <309>: DATABASE ENTRY DATE: 2019-04-01
  ref <313>: RELEVANT RESIDUES IN SEQ ID NO: (1)..(1497)
ttcaatctgagagtttgatcctggctcaggacgaacgctggcggcaggcttaacacatgcaagtcgagcgccctcttcggagggagcggcagacgggtgagtaacgcgtgggaacctacctggtggtacggaataacccggggaaactcgggctaataccgcatacgcccttcgggggaaagatttatcgccatcagatgggcccgcgtcggattagctagttggtgaggtaacggctcaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcagcggggacgataatgacggtacccgcagaagaagccccggctaactccgtgccagcagccgcggtaatacggagggggctagcgttgttcggaattactgggcgtaaagcgcacgtaggcggactgttaagtcaggggtgaaatcccgaggctcaacctcggaacagcctctgatactggcagtcttgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgtcggtcagcatgctgttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatcccggtcgcgggatccggagacggatctcttcagttcggctggaccggtgacaggtgctgcatggctgtcgtcagctcgtgtcgtgagatgttgggttaagtcccgcaacgagcgcaaccctcgcccttagttgccatcagtttcggctgggcactctaaggggactgccggtgataagccgagaggaaggtggggatgacgtcaagtcctcatggcccttacgggctgggctacacacgtgctacaatggcggtgacaatgggcagcgaacccgcgagggggagctaatctccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttctacccgaaggtggtgcgctaaccgcaaggaggcagccaaccacggtaggatcagcgactggggtgaagtcgtaacaaggtagccgtaggggaacctgcggctggatcacctcctttctaagg

SEQ ID NO: 5143 - DNA, 1400 bp, Lutispora thermophila
  ref <308>: DATABASE ACCESSION NUMBER: NCBI ACCESSION: NZ_FQZS01000002.1
  ref <309>: DATABASE ENTRY DATE: 2019-04-01
  ref <313>: RELEVANT RESIDUES IN SEQ ID NO: (1)..(1400)
aacctgccctaaagagggggataacaccgagaaatcggtgctaataccgcatgaaattagagtttcgcatgaagctttaatcaaaggagcaatccgctttaggatgggcccgcgtctgattagctagttggtgaggtaacggctcaccaaggcgacgatcagtagccgatctgagaggatgaccggccacactggaactgagacacggtccagactcctacgggaggcagcagtggggaatattgcacaatgggggaaaccctgatgcagcaacgccgcgtggaggaagaaggtcttcggattgtaaactcctgtcttctgggacgaaatatgacggtaccagaggaggaagccacggctaactacgtgccagcagccgcggtaatacgtaggtggcgagcgttgtccggaattactgggcgtaaagggcgcgtaggcggcctgttaagtcagatgtgaaaaccccgggctcaacctggggagtgcatttgaaactgatgggctagagtgtcggagagggaagcggaattcctagtgtagcggtgaaatgcgtagatattaggaggaacaccagtggcgaaggcggctttctggacgataactgacgctgaggcgcgaaagcgtggggagcaaacaggattagataccctggtagtccacgctgtaaacgatggatactaggtgtgggaggtatcgaccccttccgtgccgcagtaaacgcaataagtatcccgcctggggagtacggccgcaaggttgaaactcaaaggaattgacgggggcccgcacaagcagcggagcatgtggtttaattcgaagcaacgcgaagaaccttaccagagcttgacatctcctgcatagtccgtaatgggatgaagtccttcgggacaggaagacaggtggtgcatggttgtcgtcagctcgtgtcgtgagatgttgggttaagtcccgcaacgagcgcaacccttatacttagttgccatcattaagttgggcactctaagtagactgccggagacaattcggaggaaggtggggatgacgtcaaatcatcatgccccttatgttctgggctacacacgtgctacaatgggtataacaacgggaagcaagccagtgatggtaagcaaatccctaaaaagtactcccagttcagattgttctctgaaactcgagaacatgaagtcggagttgctagtaatcgcgaatcagcatgtcgcggtgaatacgttcccgggccttgtacacaccgcccgtcacaccatgggagttggaagcacccgaagccggtgacttaaccgcaaggagagagccgtcgaaggtgaagccaatgactggggtgaagtcgtaacaaggtagccgtatcggaaggtgcggctggatcacctcctttctaagga

SEQ ID NO: 5144 - DNA, 1496 bp, Lyngbya aestuarii
  ref <308>: DATABASE ACCESSION NUMBER: NCBI ACCESSION: NZ_AUZM01000181.1
  ref <309>: DATABASE ENTRY DATE: 2019-04-01
  ref <313>: RELEVANT RESIDUES IN SEQ ID NO: (1)..(1496)
aacacggagagtttgatcctggctcaggatgaacgctggcggtctgcttaacacatgcaagtcgaacggactcttcggagttagtggcggacgggtgagtaacgcgtgagaatctgcctctagaacggggacaacagagggaaacttctgctaatcccggatgagccgaaaggtcaaagatttatcgtctagagatgagctcgcgtctgattagctagttggtaaggtaaaagcttaccaaggcgacgatcagtagctggtctgagaggatgatcagccacactgggactgagacacggcccagactcctacgggaggcagcagtggggaattttccgcaatgggcgaaagcctgacggagcaagaccgcgtgggggaggaaagcctttgggttgtaaaccccttttctcagggaagaagaaagtgacggtacctgaggaatcagcctcggctaactccgtgccagcagccgcggtaatacggaggaggcaagcgttatccggaatgattgggcgtaaagcgttcgtaggtggcaattcaagtctgctgtcaaagacagtagctcaactactgcaaggcagtggaaactgaatagctagagtgcggtaggggcagagggaattcccggtgtagcggtgaaatgcgtagagatcgggaagaacaccggtggcgaaagcgctctgctgggccgcaactgacactgagggacgaaagctaggggagcgaatgggattagataccccagtagtcctagctgtaaacgatggaaactaggtgttgcctgtatcgacccaggcagtgccgtagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaattctggggaaactcggaagtgccttcgggaaccggaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcatcatgccccttacgtcctgggctacacacgtactacaatggtaaggacagagggcagccacttcgcgaggaggagctaatcccgtaaaccttgcctcagttcagattgcaggctgcaactcgcctgcatgaaggaggaatcgctagtaatcgcaggtcagcatactgcggtgaatccgttcccgggccttgtacacaccgcccgtcacaccatggaagttagccatgcccgaagtcattactctaacctttcgaggaggagggtgccgaaggcagggctgatgactggggtgaagtcgtaacaaggtagccgtaccggaaggtgtggctggatcacctcctttttaggga

SEQ ID NO: 5145 - DNA, 1524 bp, Lyngbya confervoides
  ref <308>: DATABASE ACCESSION NUMBER: NCBI ACCESSION: NZ_JTHE01000183.1
  ref <309>: DATABASE ENTRY DATE: 2019-04-01
  ref <313>: RELEVANT RESIDUES IN SEQ ID NO: (1)..(1524)
tactatggagagtttgatcctggctcaggatgaacgctagcgggaggcttaatacatgcaagtcgaggggcagcatgggacttcggtcctgatggcgaccggcgcacgggtgagtaacgcgtacgcaacttgcctccaagcgggggatagccccgggaaactgggattaataccccatagcatcattttatcgcctggtagaatgattaaagcttaggcgcttggagatgggcgtgcgtgccattagctagttggtaaggtaacggcttaccaaggcgacgatggctagggggcgtgagagcgtggccccccacacgggtactgagacacggacccgactcctacgggaggcagcagtaaggaatattggacaatggaggcaactctgatccagccatcccgcgtgcaggatgacggccctatgggttgtaaactgcttttgcgagggaagaaacggtgctatttatagcattttgacggtacctcgagaataagcaccggctaactccgtgccagcagccgcggtaatacggagggtgcaagcgttatccggaatcactgggtttaaagggtgcgtaggcggcattataagtcagaggtgaaagcccgtcgcttaacgatggaattgcctttgatactgtagtgcttgaatcaagttgaggctggcggaatgtggcatgtagcggtgaaatgcatagatatgccatagaacaccaattgcgaaggcagctggctggacttgaattgacgctgaggcacgaaagcgtggggagcgaacaggattagataccctggtagtccacgccctaaacgatgtttactcgttccaggcactggttgtctgggaccaagcgaaagcgttaagtaaaccacctggggagtacgtcggcaacgatgaaactcaaaggaattgacgggggtccgcacaagcggtggagcatgtggtttaattcgatgatacgcgaggaaccttacctaggctagaatgtgagcgctaccctgcgaaagcaggggttccttcgggacgcgaaacaaggtgctgcatggttgtcgtcagctcgtgccgtgaggtgttgggttaagtcccgcaacgagcgcaacccctatttccagttgccagcaataagatggggactctggaaagactgccggcgtaagccgcgaggaaggtggggatgacgtcaaatcatcatggcctttatgcctagggctacacacgtgctacaatggtgcatacagagggtagcgaagccgcgaggtggagccaatcccagaaagtgcatcccagttcggattggagtctgcaactcgactccatgaaggtggaatcgctagtaatcgcgcatcagccatggcgcggtgaatacgttcccggaccttgtacacaccgcccgtcaagccatggaagccgggggtacctgaagatggtgaccttacgaggagctatctaaggtaaaaccggtaactagggctaagtcgtaacaaggtagccgtaccggaaggtgcggctggaatacctccttt

SEQ ID NO: 5146 - DNA, 1497 bp, Lyngbya sp. PCC 8106
  ref <308>: DATABASE ACCESSION NUMBER: NCBI ACCESSION: NZ_AAVU01000008.1
  ref <309>: DATABASE ENTRY DATE: 2019-04-01
  ref <313>: RELEVANT RESIDUES IN SEQ ID NO: (1)..(1497)
aacacggagagtttgatcctggctcaggatgaacgctggcggtctgcttaacacatgcaagtcgaacggactcttcggagttagtggcggacgggtgagtaacgcgtgagaatctgcctctagaacggggacaacagagggaaacttctgctaatcccggatgagccgaaaggtcaaagatttatcgtctagagatgagctcgcgtctgattagctagttggtaaggtaaaagcttaccaaggcgacgatcagtagctggtctgagaggatgatcagccacactgggactgagacacggcccagactcctacgggaggcagcagtggggaattttccgcaatgggcgcaagcctgacggagcaagaccgcgtgggggaggaaaagcctttgggttgtaaaccccttttctcagggaagaagaaagtgacggtacctgaggaatcagcctcggctaactccgtgccagcagccgcggtaatacggaggaggcaagcgttatccggaatgattgggcgtaaagcgttcgtaggtggcaattcaagtctgctgtcaaagacagtagctcaactactgcaaggcagtggaaactgaatagctagagtgcggtaggggcagagggaattcccggtgtagcggtgaaatgcgtagagatcgggaagaacaccggtggcgaaagcgctctgctgggccgcaactgacactgagggacgaaagctaggggagcgaatgggattagataccccagtagtcctagctgtaaacgatggaaactaggtgttgcctgtatcgacccaggcagtgccgtagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaattctggggaaactcggaagtgccttcgggaaccggaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcatcatgccccttacgtcctgggctacacacgtactacaatggtaaggacaaagggcagccacttcgcgaggaggagctaatcccgtaaaccttgcctcagttcagattgcaggctgcaactcgcctgcatgaaggaggaatcgctagtaatcgcaggtcagcatactgcggtgaatccgttcccgggccttgtacacaccgcccgtcacaccatggaagttaaccatgcccgaagtcattactctaacctttcgaggaggagggtgccgaaggcagggttgatgactggggtgaagtcgtaacaaggtagccgtaccggaaggtgtggctggatcacctcctttataggga

SEQ ID NO: 5147 - DNA, 1559 bp, Lysinibacillus contaminans
  ref <308>: DATABASE ACCESSION NUMBER: NCBI ACCESSION: NZ_LGRV01000001.1
  ref <309>: DATABASE ENTRY DATE: 2019-04-01
  ref <313>: RELEVANT RESIDUES IN SEQ ID NO: (1)..(1559)
ttttatggagagtttgatcctggctcaggacgaacgctggcggcgtgcctaatacatgcaagtcgagcgaattgatgaagaagcttgcttcttctgatgttagcggcggacgggtgagtaacacgtgggcaacctaccttatagtttgggataactccgggaaaccggggctaataccgaataatctatttcctctcatggggaaatactaaaagacggtttcggctgtcgctataagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggttctttaagtctgatgtgaaagcccacggctcaaccgtggagggtcattggaaactggggaacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccattgaccactgtagagatacagttttcccttcggggacaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaacccgcgagggggagctaatccgataaagtcgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtgaggtaacctttttggagccagccgccgaaggtgggatagatgattggggtgaagtcgtaacaaggtagccgtatcggaaggtgcggctggatcacctcctttcta

SEQ ID NO: 5148 - DNA, 1557 bp, Lysinibacillus macroides
  ref <308>: DATABASE ACCESSION NUMBER: NCBI ACCESSION: NZ_LGCI01000008.1
  ref <309>: DATABASE ENTRY DATE: 2019-04-01
  ref <313>: RELEVANT RESIDUES IN SEQ ID NO: (1)..(1557)
ttttatggagagtttgatcctggctcaggacgaacgctggcggcgtgcctaatacatgcaagtcgagcgaacagagaaggagcttgctccttcgacgttagcggcggacgggtgagtaacacgtgggcaacctaccctatagtttgggataactccgggaaaccggggctaataccgaataatctctttcacttcatggtgaaagactgaaagacggttttggctgtcgctataggatgggcccgcggcgcattagctagttggtgaggtaatggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaa

SEQ ID NO: 5149 - DNA, 1557 bp, Lysinibacillus sp. A1
  ref <308>: DATABASE ACCESSION NUMBER: NCBI ACCESSION: NZ_JSZM01000022.1
  ref <309>: DATABASE ENTRY DATE: 2019-04-01
  ref <313>: RELEVANT RESIDUES IN SEQ ID NO: (1)..(1557)
ttttatggagagtttgatcctggctcaggacgaacgctggcggcgtgcctaatacatgcaagtcgagcgaacagagaaggagcttgctccttcgacgttagcggcggacgggtgagtaacacgtgggcaacctaccttatagtttgggataactccgggaaaccggggctaataccgaataatctgtttcacctcatggtgaaacactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatggtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaa

SEQ ID NO: 5150 - DNA, 1464 bp, Lysinibacillus sp. AC-3; identical to SEQ ID NO: 646
  ref <308>: DATABASE ACCESSION NUMBER: NCBI ACCESSION: NZ_FUYW01000050.1
  ref <309>: DATABASE ENTRY DATE: 2019-04-01
  ref <313>: RELEVANT RESIDUES IN SEQ ID NO: (1)..(1464)

SEQ ID NO: 5151 - DNA, 1557 bp, Lysinibacillus sp. AR18-8
  ref <308>: DATABASE ACCESSION NUMBER: NCBI ACCESSION: NZ_MDGU01000016.1
  ref <309>: DATABASE ENTRY DATE: 2019-04-01
  ref <313>: RELEVANT RESIDUES IN SEQ ID NO: (1)..(1557)
ttttatggagagtttgatcctggctcaggacgaacgctggcggcgtgcctaatacatgcaagtcgagcgaacagaaaaggagcttgctcctttgacgttagcggcggacgggtgagtaacacgtgggcaacctaccctatagtttgggataactccgggaaaccggggctaataccgaataatctcttttgcttcatggtgaaagactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaa

SEQ ID NO: 5152 - DNA, 1472 bp, Lysinibacillus sp. F5
  ref <308>: DATABASE ACCESSION NUMBER: NCBI ACCESSION: NZ_LKIE01000078.1
  ref <309>: DATABASE ENTRY DATE: 2019-04-01
  ref <313>: RELEVANT RESIDUES IN SEQ ID NO: (1)..(1472)
gctccttcgacgttagcggcggacgggtgagtaacacgtgggcaacctaccttatagtttgggataactccgggaaaccggggctaataccgaataatctgtttcacctcatggtgaaacactgaaagacggtttcggctgtcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagtttccccttcgggggcaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaa

SEQ ID NO: 5153 - DNA, 1638 bp, Lysinibacillus sp. FJAT-14222
  misc_feature (365)..(365): n is a, c, g, or t
  ref <308>: DATABASE ACCESSION NUMBER: NCBI ACCESSION: NZ_LIYL01000010.1
  ref <309>: DATABASE ENTRY DATE: 2019-04-01
  ref <313>: RELEVANT RESIDUES IN SEQ ID NO: (1)..(1638)
ttttatggagagtttgatcctggctcaggacgaacgctggcggcgtgcctaatacatgcaagtcgagcgaacagagaaggagcttgctcctttgacgttagcggcggacgggtgagtaacacgtgggcaacctaccttatagtttgggataactccgggaaaccggggctaataccgaataatctatttcacttcatggtgaaatattgaaagacggtctcggctgtcgctataagatgggcccgcggcgcattagctagttggtgaggtaacggctcaccaaggcgacgatgcgtagccgacctgagagggtgatcggccacactgggactgagacacggcccagactcctacgggaggcagcnacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatagttttcccttcggggacaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgccgaaggtgggatagatgattggggtgaagtcgtaacaaggtagccgtatcggaaggtgcggctggatcacctcctttctaagga

SEQ ID NO: 5154 - DNA, 1557 bp, Lysinibacillus sp. FJAT-14745
  ref <308>: DATABASE ACCESSION NUMBER: NCBI ACCESSION: NZ_LITM01000004.1
  ref <309>: DATABASE ENTRY DATE: 2019-04-01
  ref <313>: RELEVANT RESIDUES IN SEQ ID NO: (1)..(1557)
ttttatggagagtttgatcctggctcaggacgaacgctggcggcgtgcctaatacatgcaagtcgagcgaacgtcaaaggagcttgctcctttgacgttagcggcggacgggtgagtaacacgtgggcaacctaccttatagtttgggataactccgggaaaccggggctaataccgaataatctattttgcttcatggcgaaatactgaaagacggtttcggctgtcgctataagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatggttttcccttcggggacaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgccgaaggtgggatagatgattggggtgaagtcgtaacaaggtagccgtatcggaaggtgcggctggatcacctcctttctaa

SEQ ID NO: 5155 - DNA, 1557 bp, Lysinibacillus sp. LK3; identical to SEQ ID NO: 5151
  ref <308>: DATABASE ACCESSION NUMBER: NCBI ACCESSION: NZ_LDUJ01000010.1
  ref <309>: DATABASE ENTRY DATE: 2019-04-01
  ref <313>: RELEVANT RESIDUES IN SEQ ID NO: (1)..(1557)

SEQ ID NO: 5156 - DNA, 1558 bp, Lysinibacillus varians
  ref <308>: DATABASE ACCESSION NUMBER: NCBI ACCESSION: NZ_CP006837.1
  ref <309>: DATABASE ENTRY DATE: 2019-04-01
  ref <313>: RELEVANT RESIDUES IN SEQ ID NO: (1)..(1558)
ttttatggagagtttgatcctggctcaggacgaacgctggcggcgtgcctaatacatgcaagtcgagcgaacagagaaggagcttgctcctttgacgttagcggcggacgggtgagtaacacgtgggcaacctaccctatagtttgggataactccgggaaaccggggctaataccgaataatcttttgtccctcatgggacaatactgaaagacggcatctcgctgtcgctataggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccacaatgggcgaaagcctgatggagcaacgccgcgtgagtgaagaaggatttcggttcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggagacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactgtagagatatggttttcccttcggggacaacggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaacggttgccaactcgcgagagggagctaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaa

SEQ ID NO: 5157 - DNA, 1529 bp, Lysinimonas sp. 2DFWR-13
  ref <308>: DATABASE ACCESSION NUMBER: NCBI ACCESSION: NZ_CP032630.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacggtgaaagtgggagcttgctcctgctggatcagtggcgaacgggtgagtaacacgtgagcaatctgccccgaactctgggataagcgttggaaacgacgtctaataccggatacgacgcgcgaaggcatcttctgcgcgtggaaagaacttcggttcgggatgagctcgcggcctatcagcttgttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtctgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggaactagatgtgggggccattccacggcttccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatacgagaacgctctagaaatagagaactctttggacactcgtatacaggtggtgcatggttgtcgtcagctcgtgtcgtgagatgttgggttaagtcccgcaacgagcgcaaccctcgttctatgttgccagcacgtcatggtgggaactcataggagactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcccaacccttgtggagggagccgtcgaaggtgggatcggtgattaggactaagtcgtaacaaggtagccgtaccggaaggtgcggctggatcacctcctttcta

SEQ ID NO: 5158 - DNA, 1546 bp, Lysobacter maris
  ref <308>: DATABASE ACCESSION NUMBER: NCBI ACCESSION: NZ_CP029843.1
  ref <309>: DATABASE ENTRY DATE: 2019-04-01
  ref <313>: RELEVANT RESIDUES IN SEQ ID NO: (1)..(1546)
taagtgaagagtttgatcctggctcagagtgaacgctggcggcaggcctaacacatgcaagtcgaacggcagcacgagagagcttgctctcttggtggcgagtggcggacgggtgaggaatgcgtcggaatctgcctatttgtgggggataacgtagggaaacttacgctaataccgcatacgacctacgggtgaaagtgggggatcttcggacctcacgcagatagatgagccgacgtcggattagctagttggcggggtaaaggcccaccaaggcgacgatccgtagctggtctgagaggatgatcagccacactgggactgagacacggcccagactcctacgggaggcagcagtggggaatattggacaatgggcgcaagcctgatccagccatgccgcgtgtgtgaagaaggccttcgggttgtaaagcacttttgtacgggaagaaacgcgatcggttaatacccggtcgaactgacggtaccgtaagaataagcaccggctaacttcgtgccagcagccgcggtaatacgaagggtgcaagcgttactcggaattactgggcgtaaagcgtgcgtaggtggtttgttaagtcagatgtgaaagccctgggctcaacctgggaactgcatttgatactggcaggctagagtgcggtagagggtagcggaattcccggtgtagcagtgaaatgcgtagatatcgggaggaacatccgtggcgaaggcggctacctggaccagcactgacactgaggcacgaaagcgtggggagcaaacaggattagataccctggtagtccacgccctaaacgatgcgaactggatgttggggacacttaggtcttcagtatcgaagctaacgcgttaagttcgccgcctgggaagtacggtcgcaagactgaaactcaaaggaattgacgggggcccgcacaagcggtggagtatgtggtttaattcgatgcaacgcgcagaaccttacctggccttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggcgacaagccggaggaaggtggggatgacgtcaagtcatcatggcccttacggccagggctacacacgtactacaatggtggggacagagggctgcaagccggcgacggtgagccaatcccagaaaccccatctcagtccggattggagtctgcaactcgactccatgaagtcggaatcgctagtaatcgcagatcagcattgctgcggtgaatacgttcccgggccttgtacacaccgcccgtcacaccatgggagtgggttgctccagaagtagctagtctaaccttcgggaggacggttaccacggagtgattcatgactggggtgaagtcgtaacaaggtagccgtatcggaaggtgcggctggatcacctcctttc

SEQ ID NO: 5159 - DNA, 1556 bp, Macrococcus bohemicus
  ref <308>: DATABASE ACCESSION NUMBER: NCBI ACCESSION: NZ_PZJG01000020.1
  ref <309>: DATABASE ENTRY DATE: 2019-04-01
  ref <313>: RELEVANT RESIDUES IN SEQ ID NO: (1)..(1556)
attatggagagtttgatcctggctcaggatgaacgctggcggcgtgcctaatacatgcaagtcgagcgaattgacagaggtgcttgcacctctcgattttagcggcggacgggtgagtaacacgtgggtaacctacctataagactgggataacttcgggaaaccggagctaataccggataatatttagcttcgcatgaagcaatagtgaaagacggttctgctgtcacttatagatggacctgcggtgtattagctagttggtgaggtaacggctcaccaaggcaacgatacatagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtaagggaagaacaagtacgttagtaactgaacgtaccttgacggtaccttaccagaaagccacggctaactacgtgccagcagccgcggtaatacgtaggtggcaagcgttatccggaattattgggcgtaaagcgcgcgtaggcggtctcttaagtctgatgtgaaagcccccggctcaaccggggagggtcattggaaactgggagacttgagtacagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttatctttagttgccatcattcagttgggcactctagagagactgccggtgacaaaccggaggaaggtggggatgacgtcaaatcatcatgccccttatgatttgggctacacacgtgctacaatggatggtacaaagggcagcaaaaccgcgaggtcaagcaaatcccataaaaccattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacagatgattggggtgaagtcgtaacaaggtagccgtatcggaaggtgcggctggatcacctcctttct

SEQ ID NO: 5160 - DNA, 1556 bp, Macrococcus canis
  ref <308>: DATABASE ACCESSION NUMBER: NCBI ACCESSION: NZ_CP021059.1
  ref <309>: DATABASE ENTRY DATE: 2019-04-01
  ref <313>: RELEVANT RESIDUES IN SEQ ID NO: (1)..(1556)
attatggagagtttgatcctggctcaggatgaacgctggcggcgtgcctaatacatgcaagtcgagcgaacagacgagagtgcttgcactctctgacgttagcggcggacgggtgagtaacacgtgggtaacctacctataagactgggataacttcgggaaaccggagctaataccggataatatttagcttcgcatgaagcaatagtgaaagacggttctgctgtcacttatagatggacccgcggtgtattagctagttggtgaggtaacggctcaccaaggcaacgatacatagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtaagggaagaacaagtacgttagtaactgaacgtaccttgacggtaccttaccagaaagccacggctaactacgtgccagcagccgcggtaatacgtaggtggcaagcgttatccggaattattgggcgtaaagcgcgcgtaggcggtctcttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttatctttagttgccatcattaagttgggcactctagagagactgccggtgataaaccggaggaaggtggggatgacgtcaaatcatcatgccccttatgatttgggctacacacgtgctacaatggatggtacaaagggcagcaaaaccgcgaggtcaagcaaatcccataaaaccattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacagatgattggggtgaagtcgtaacaaggtagccgtatcggaaggtgcggctggatcacctcctttct

SEQ ID NO: 5161 - DNA, 1289 bp, Macrococcus caseolyticus
  ref <308>: DATABASE ACCESSION NUMBER: NCBI ACCESSION: NZ_RBVL01000025.1
  ref <309>: DATABASE ENTRY DATE: 2019-04-01
  ref <313>: RELEVANT RESIDUES IN SEQ ID NO: (1)..(1289)
ctgctgtcacttatagatggacccgcggtgtattagctagttggtgaggtaacggctcaccaaggcaacgatacatagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtaagggaagaacaagtacgttagtaactgaacgtaccttgacggtaccttaccagaaagccacggctaactacgtgccagcagccgcggtaatacgtaggtggcaagcgttatccggaattattgggcgtaaagcgcgcgtaggcggtctcttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttatctttagttgccatcattaggttgggcactctagagagactgccggtgacaaaccggaggaaggtggggatgacgtcaaatcatcatgccccttatgatttgggctacacacgtgctacaatggatggtacaaagggcagcaaaaccgcgaggtcaagcaaatcccataaaaccattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttctaggagctagccgtcgaaggtgggacagatgattggggtgaagtcg

SEQ ID NO: 5162 - DNA, 1556 bp, Macrococcus epidermidis
  ref <308>: DATABASE ACCESSION NUMBER: NCBI ACCESSION: NZ_PZJH01000018.1
  ref <309>: DATABASE ENTRY DATE: 2019-04-01
  ref <313>: RELEVANT RESIDUES IN SEQ ID NO: (1)..(1556)
attatggagagtttgatcctggctcaggatgaacgctggcggcgtgcctaatacatgcaagtcgagcgaattgacagaggtgcttgcacctctcgattttagcggcggacgggtgagtaacacgtgggtaacctacctataagactgggataacttcgggaaaccggagctaataccggataatatttagcttcgcatgaagcaatagtgaaagacggttctgctgtcacttatagatggacctgcggtgtattagctagttggtgaggtaacggctcaccaaggcaacgatacatagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtaagggaagaacaagtacgttagtaactgaacgtaccttgacggtaccttaccagaaagccacggctaactacgtgccagcagccgcggtaatacgtaggtggcaagcgttatccggaattattgggcgtaaagcgcgcgtaggcggtctcttaagtctgatgtgaaagcccccggctcaaccggggagggtcattggaaactgggagacttgagtacagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttatctttagttgccatcattaagttgggcactctagagagactgccggtgacaaaccggaggaaggtggggatgacgtcaaatcatcatgccccttatgatttgggctacacacgtgctacaatggatggtacaaagggcagcaaaaccgcgaggtcaagcaaatcccataaaaccattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacagatgattggggtgaagtcgtaacaaggtagccgtatcggaaggtgcggctggatcacctcctttct

SEQ ID NO: 5163 - DNA, 1556 bp, Macrococcus goetzii; identical to SEQ ID NO: 5162
  ref <308>: DATABASE ACCESSION NUMBER: NCBI ACCESSION: NZ_MJBI02000020.1
  ref <309>: DATABASE ENTRY DATE: 2019-04-01
  ref <313>: RELEVANT RESIDUES IN SEQ ID NO: (1)..(1556)

SEQ ID NO: 5164 - DNA, 1485 bp, Macrococcus sp. DPC7161
  ref <308>: DATABASE ACCESSION NUMBER: NCBI ACCESSION: NZ_SDSC01000020.1
  ref <309>: DATABASE ENTRY DATE: 2019-04-01
  ref <313>: RELEVANT RESIDUES IN SEQ ID NO: (1)..(1485)
agagtgcttgcactctttgatgttagcggcggacgggtgagtaacacgtgggtaacctacctataagactgggataacttcgggaaaccggagctaataccggataatatttttctctgcatggaggaatagtgaaagacggttttgctgtcacttatagatggacccgcggtgtattagctagttggtgaggtaacggctcaccaaggcaacgatacatagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtaagggaagaacaagtacgttagtaactgaacgtaccttgacggtaccttaccagaaagccacggctaactacgtgccagcagccgcggtaatacgtaggtggcaagcgttatccggaattattgggcgtaaagcgcgcgtaggcggtttcttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacggggacccgcacaagcggtggagcatgtggtttaattcgaagcaacgcgaagaaccttaccaattcttgacatcctttgacaactctagagatagagctttccccttcgggggacaaagtgacaggtggtgcatggttgtcgtcagctcgtgtcgtgagatgttgggttaagtcccgcaacgagcgcaacccttatctttagttgccatcattaagttgggcactctagagagactgccggtgacaaaccggaggaaggtggggatgacgtcaaatcatcatgccccttatgaattgggctacacacgtgctacaatggacggtacaaagggcagcaaaaccgcgaggtcaagcaaatcccataaaaccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacagatgattggggtgaagtcgtaacaaggtagccgtatcggaaggtgcggctggatcacctcctttctaagga

SEQ ID NO: 5165 - DNA, 1560 bp, Macrococcus sp. IME1552
  ref <308>: DATABASE ACCESSION NUMBER: NCBI ACCESSION: NZ_CP017156.1
  ref <309>: DATABASE ENTRY DATE: 2019-04-01
  ref <313>: RELEVANT RESIDUES IN SEQ ID NO: (1)..(1560)
ctattatggagagtttgatcctggctcaggatgaacgctggcggcgtgcctaatacatgcaagtcgagcgaattgacagaggtgcttgcacctctcgattttagcggcggacgggtgagtaacacgtgggtaacctacctataagactgggataacttcgggaaaccggagctaataccggataatatttagcttcgcatgaagtaatagtgaaagacggttctgctgtcacttatagatggacctgcggtgtattagctagttggtgaggtaacggctcaccaaggcaacgatacatagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtaagggaagaacaagtacgttagtaactgaacgtaccttgacggtaccttaccagaaagccacggctaactacgtgccagcagccgcggtaatacgtaggtggcaagcgttatccggaattattgggcgtaaagcgcgcgtaggcggtctcttaagtctgatgtgaaagcccccggctcaaccggggagggtcattggaaactgggagacttgagtacagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttatctttagttgccatcattaagttgggcactctagagagactgccggtgacaaaccggaggaaggtggggatgacgtcaaatcatcatgccccttatgatttgggctacacacgtgctacaatggatggtacaaagggcagcaaaaccgcgaggtcaagcaaatcccataaaaccattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacagatgattggggtgaagtcgtaacaaggtagccgtatcggaaggtgcggctggatcacctcctttctaa

SEQ ID NO: 5166 - DNA, 1239 bp, Mageeibacillus indolicus
  ref <308>: DATABASE ACCESSION NUMBER: NCBI ACCESSION: NZ_NBZD01000004.1
  ref <309>: DATABASE ENTRY DATE: 2019-04-01
  ref <313>: RELEVANT RESIDUES IN SEQ ID NO: (1)..(1239)
agacgagctgagaggtttatcggccacattgggactgagacacggcccagactcctacgggaggcagcagtggggaatattgggcaatgggcgaaagcctgacccagcaacgccgcgtgaagtatgaaggccttcgggttgtaaacttctttgatcagggaagaaacaaatgacggtacctgaaaaacaagccacggctaactacgtgccagcagccgcggtaatacgtaggtggcgagcgttatccggatttactgggtgtaaagggcgtgcaggcgggctgataagtcagatgcgaaatccccgagcttaactcgggaactgcatctgatactgttggtcttgagtgctggagaggatagtggaattcctagtgtagcggtaaaatgcgcagatattaggaggaacaccagtggcgaaggcggctatctggacagtaactgacgctgaggcgcgaaagcgtgggtagcaaacaggattagataccctggtagtccacgccgtaaacgatgattactaggtgtaggaggtatcgaccccttctgtgccggagttaacacaataagtaatccacctggggagtacggccgcaaggttgaaactcaaaggaattgacgggggcccgcacaagcagtggagtatgtggtttaattcgacgcaacgcgaagaaccttaccagggtttgacatcccttgaacgatgtagagatacataattcccttcggggacaaggagacaggtggtgcatggttgtcgtcagctcgtgtcgtgagatgttgggttaagtcccgcaacgagcgcaacccctattgccagttgccatcatttagttgggcactcaggcgagactgccgttgataaaacggaggaaggtggggatgacgtcaaatcatcatgccccttatatcctgggctacacacgtactacaatggctacaacagagagcagcgacgtcgcgaggcgaagcaaatccccaaatgtagtctcagttcggattgcaggctgcaactcgcctgcatgaagccggaattgctagtaatggcaggtcagcatactgccgtgaatacgttctcgggccttgtacacaccgcccgtcacaccatgagagtcagtaacacccgaagtcagtagtctaaccgcaagggggacgctgccgaaggtgggaccgataattggggtgaagtcgtaacaaggtagccgtatcggaaggtgcggctggatcacctcctttctaagga

SEQ ID NO: 5167 - DNA, 1505 bp, Magnetospira sp. QH-2
  ref <308>: DATABASE ACCESSION NUMBER: NCBI ACCESSION: NZ_FO538765.1
  ref <309>: DATABASE ENTRY DATE: 2019-04-01
  ref <313>: RELEVANT RESIDUES IN SEQ ID NO: (1)..(1505)
tcaacttgagagtttgatcctggctcaaaacgaacgctggcggcaggcctaacacatgcaagtcgaacgtgaagctatcttcggatagtggaaagtggcgcacgggtgagtaacgcgtggggatttgcctcagagtgggggataacggttggaaacgactgctaataccgcatacgcccttcgggggaaagatttatcgctctgagatgaacccgcgtctgattaggtagttggtggggtaacggcctaccaagccgacgatcagtagctggtctgagaggatgatcagccacactggaactgagacacggtccagactcctacgggaggcagcagtggggaatattggacaatgggggcaaccctgatccagccatgccgcgtgagtgaagaaggccctagggttgtaaaactctttcagctgtgacgatgatgacggtagcagcagaagaagccccggctaactccgtgccagcagccgcggtaatacggagggggctagcgttgttcggaattactgggcgtaaagcgcgcgtaggcggcgcatccagttagaggtgaaagccctgggctcaacccaggaactgcctttaatactgatgtgctagagaccggaagagggtagtggaattcccagtgtagaggtgaaattcgtagatattgggaagaacaccagtggcgaaggcgactacctggtccggatctgacgctgaggtgcgaaagcgtggggagcaaacaggattagataccctggtagtccacgccgtaaacgatgagtgctaggtgtcgggatgcttgcatttcggtgccgcagctaacgcgttaagcactccgcctggggagtacggccgcaaggttaaaactcaaaggaattgacgggggcccgcacaagcggtggagcatgtggtttaattcgaagcaacgcgcagaaccttaccagcctttgacatcccgatcgcggtttccagagatggattccttcagttcggctggatcggtgacaggtgctgcatggctgtcgtcagctcgtgtcgtgagatgttgggttaagtcccgcaacgagcgcaaccctcgcccttagttgccatcatttagttgggcactctaggggaactgccggtgacaagccggaggaaggtggggatgacgtcaagtcctcatggcccttacaggctgggctacacacgtgctacaatggcgatgacaatgggtcgcgaacctgcgagggtgagctaatctccaaaagtcgtctcagttcggattgttctctgcaactcgagagcatgaagtcggaatcgctagtaatcgcggatcagcatgccgcggtgaatacgttcccgggccttgtacacaccgcccgtcacaccatggggagttggttctacccgaaggcgatttgctaaccgtaagggagcggtcgaccacggtagggtcagcgactggggtgaagtcgtaacaaggtagccgtaggggaacctgcggctggatcacctcctttcaaggaa

SEQ ID NO: 5168 - DNA, 1496 bp, Magnetospirillum caucaseum
  ref <308>: DATABASE ACCESSION NUMBER: NCBI ACCESSION: NZ_AONQ01000023.1
  ref <309>: DATABASE ENTRY DATE: 2019-04-01
  ref <313>: RELEVANT RESIDUES IN SEQ ID NO: (1)..(1496)
tttggaagtcaacttgagagtttgatcctggctcagaacgaacgctggcggcaggcttaacacatgcaagtcgaacgaagtcttcggacttagtggcgcacgggtgagtaacacgtgggaatatacctcttggtggggaataacatcgggaaactgatgctaataccgcatacgcctcggggaaagatttatcgccgagagattagcccgcgtccgattagctagttggtgaggtaatggctcaccaaggcgacgatcggtagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctctttcacccacgacgatgatgacggtagtgggagaagaagccccggctaacttcgtgccagcagccgcggtaatacgaagggggctagcgttgttcggaattactgggcgtaaagcgcacgcaggcggtggtcatagtcagaagtgaaagccctgggctcaacccgggaattgcttttgatactggaccgctagaatcacggagagggtagtggaattccgagtgtagaggtgaaattcgtagatattcggaagaacaccagtggcgaaggcgactacctggccgtcgattgacgctcatgtgcgaaagcgtggggagcaaacaggattagataccctggtagtccacgccgtaaacgatgagtgctagttgttggggtgcatgcacctcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccagcccttgacatgggacgtatgtttgccagagatggtgacttgtcttcggacgcgtccgcacaggtgctgcatggctgtcgtcagctcgtgtcgtgagatgttgggttaagtcccgcaacgagcgcaaccctcatcttcagttgccagcatttagttgggcactctgaagaaactgccggtgacaagccggaggaaggtggggatgacgtcaagtcctcatggcccttacgggctgggctacacacgtgctacaatggtggtgacagtgggtcgctaactcgcgagagtatgctaatccctaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggctttacccgaagccggtgcgctaaccgcaaggaggcagccgaccacggtaaggtcagcgactggggtgaagtcgtaacaaggtagccgtaggggaacctgcggctggatcacctcctttcaagga

SEQ ID NO: 5169 - DNA, 1489 bp, Magnetospirillum gryphiswaldense
  ref <308>: DATABASE ACCESSION NUMBER: NCBI ACCESSION: NZ_CP027527.1
  ref <309>: DATABASE ENTRY DATE: 2019-04-01
  ref <313>: RELEVANT RESIDUES IN SEQ ID NO: (1)..(1489)
caacttgagagtttgatcctggctcagaacgaacgctggcggcaggcctaacacatgcaagtcgaacgaagtcttcggacttagtggcgcacgggtgagtaacacgtgggaatatacctttcgctgggggataacatcgggaaactgatgctaataccgcatacgccctacgggggaaagatttatcggcgagagattagcccgcgtccgattaggtagttggtgaggtaacggctcaccaagcctgcgatcggtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgacggggacgatgatgacggtacccgtagaagaagccccggctaacttcgtgccagcagccgcggtaatacgaagggggctagcgttgttcggaattactgggcgtaaagcgcacgcaggcggttcgatcagtcagaagtgaaagccccgggcttaacctgggaactgcttttgatactgtcgagcttgaatcacggagagggtagtggaattccgagtgtagaggtgaaattcgtagatattcggaagaacaccagtggcgaaggcgactacctggccgtcgattgacgctcatgtgcgaaagcgtggggagcaaacaggattagataccctggtagtccacgccgtaaacgatgagtgctagttgttggggtgcatgcacctcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccagcctttgacatggaacgtatgatcaccagagatggtgacttgtcttcggacgcgttcacacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacaatgggttgctaacccgcgagggccagctaatctccaaaagccatctcagttcggattgtactctgcaactcgagtgcatgaagtcggaatcgctagtaatcgtggatcagcatgccacggtgaatacgttcccgggccttgtacacaccgcccgtcacaccatgggagttggttttacccgaagccggtgagctaaccgcaaggaggcagccgaccacggtaaggtcagcgactggggtgaagtcgtaacaaggtagccgtaggggaacctgcggctggatcacctcctttcaagg

SEQ ID NO: 5170 - DNA, 1498 bp, Magnetospirillum magneticum
  ref <308>: DATABASE ACCESSION NUMBER: NCBI ACCESSION: NC_007626.1
  ref <309>: DATABASE ENTRY DATE: 2019-04-01
  ref <313>: RELEVANT RESIDUES IN SEQ ID NO: (1)..(1498)
ttggaagtcaacttgagagtttgatcctggctcagaacgaacgctggcggcaggcttaacacatgcaagtcgaacgaagtcttcggacttagtggcgcacgggtgagtaacacgtgggaatatacctcttggtggggaataacatcgggaaactgatgctaataccgcatacgcccttcgggggaaagatttatcgccgagagattagcccgcgtccgattagctagttggtgaggtaatggctcaccaaggcgacgatcggtagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctctttcacccacgacgatgatgacggtagtgggagaagaagccccggctaacttcgtgccagcagccgcggtaatacgaagggggctagcgttgttcggaattactgggcgtaaagcgcacgcaggcggtggtcatagtcagaagtgaaagccctgggctcaacccgggaattgcttttgatactggaccgctagaatcacggagagggtagtggaattccgagtgtagaggtgaaattcgtagatattcggaagaacaccagtggcgaaggcgactacctggccgtcgattgacgctcatgtgcgaaagcgtggggagcaaacaggattagataccctggtagtccacgccgtaaacgatgagtgctagttgttggggtgcatgcacctcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccagcccttgacatgggacgtatgtttgccagagatggtgacttgtcttcggacgcgtccacacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacagtgggtcgctaactcgcgagagtatgctaatccctaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggctttacccgaagccggtgcgctaaccgcaaggaggcagccgaccacggtaaggtcagcgactggggtgaagtcgtaacaaggtagccgtaggggaacctgcggctggatcacctcctttcaagga

SEQ ID NO: 5171 - DNA, 1494 bp, Magnetospirillum magnetotacticum
  ref <308>: DATABASE ACCESSION NUMBER: NCBI ACCESSION: NZ_JXSL01000030.1
  ref <309>: DATABASE ENTRY DATE: 2019-04-01
  ref <313>: RELEVANT RESIDUES IN SEQ ID NO: (1)..(1494)
gaagtcaacttgagagtttgatcctggctcagaacgaacgctggcggcaggcttaacacatgcaagtcgaacgaagtcttcggacttagtggcgcacgggtgagtaacacgtgggaatatacctcttggtggggaataacgtcgggaaactgacgctaataccgcatacgcccttcgggggaaagatttatcgccgagagattagcccgcgtccgattagctagttggtgaggtaatggctcaccaaggcgacgatcggtagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctctttcacccacgacgatgatgacggtagtgggagaagaagccccggctaacttcgtgccagcagccgcggtaatacgaagggggctagcgttgttcggaattactgggcgtaaagcgcacgcaggcggtggtcatagtcagaagtgaaagccctgggctcaacccgggaattgcttttgatactggaccgctagaatcacggagagggtagtggaattccgagtgtagaggtgaaattcgtagatattcggaagaacaccagtggcgaaggcgactacctggccgtcgattgacgctcatgtgcgaaagcgtggggagcaaacaggattagataccctggtagtccacgccgtaaacgatgagtgctagttgttggggtgcatgcacctcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccagcccttgacatgggacgtatgtttgccagagatggtgacttgtcttcggacgcgtccacacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacagtgggtcgctaactcgcgagagtatgctaatccctaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggctttacccgaagccggtgcgctaaccgcaaggaggcagccgaccacggtaaggtcagcgactggggtgaagtcgtaacaaggtagccgtaggggaacctgcggctggatcacctcctttcaagg

SEQ ID NO: 5172 - DNA, 1494 bp, Magnetospirillum marisnigri
  ref <308>: DATABASE ACCESSION NUMBER: NCBI ACCESSION: NZ_LWQT01000093.1
  ref <309>: DATABASE ENTRY DATE: 2019-04-01
  ref <313>: RELEVANT RESIDUES IN SEQ ID NO: (1)..(1494)
gaagtcaacttgagagtttgatcctggctcagaacgaacgctggcggcaggcttaacacatgcaagtcgaacgaaggcttcggccttagtggcgcacgggtgagtaacacgtgggaatatacctcttggtgggggataacgtcgggaaactgacgctaataccgcatacgcccttcgggggaaagatttatcgccgagagattagcccgcgtccgattagctagttggtgaggtaacggctcaccaaggcgacgatcggtagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcacccacgacgatgatgacggtagtgggagaagaagccccggctgacttcgtgccagcagccgcggtaatacgaagggggctagcgttgttcggaattactgggcgtaaagcgcacgcaggcggtgaccatagtcagaagtgaaagccctgggctcaacccgggaattgcttttgatactgggttactagaatcacggagagggtagtggaattccgagtgtagaggtgaaattcgtagatattcggaagaacaccagtggcgaaggcgactacctggccgtcgattgacgctcatgtgcgaaagcgtggggagcaaacaggattagataccctggtagtccacgctgtaaacgatgagtgctagttgttggggtgcatgcacctcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccagcccttgacatgggacgtatgttggtcagagatgacctcttgtcttcggacgcgtccgcacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacagtgggctgctaactcgcgagagtaagctaatccctaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaagccggtgagctaaccgcaaggaggcagccgaccacggtaaggtcagcgactggggtgaagtcgtaacaaggtagccgtaggggaacctgcggctggatcacctcctttcaagg

SEQ ID NO: 5173 - DNA, 1500 bp, Magnetospirillum moscoviense
  ref <308>: DATABASE ACCESSION NUMBER: NCBI ACCESSION: NZ_LWQU01000021.1
  ref <309>: DATABASE ENTRY DATE: 2019-04-01
  ref <313>: RELEVANT RESIDUES IN SEQ ID NO: (1)..(1500)
ttggaagtcaacttgagagtttgatcctggctcagaacgaacgctggcggcaggcttaacacatgcaagtcgaacgaagtcttcggacttagtggcgcacgggtgagtaacacgtgggaatatacctttcggtgggggataacgtcgggaaactgacgctaataccgcatacgccccttgggggaaagatttatcgccgagagattagcccgcgtccgattagctagttggtgaggtaacggctcaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgacggggacgatgatgacggtacccgtagaagaagccccggctaacttcgtgccagcagccgcggtaatacgaagggggctagcgttgttcggaattactgggcgtaaagcgcacgcaggcggttcgatcagtcagaagtgaaagccccgggctcaacctgggaactgcttttgatactgtcgagcttgaatcacggagagggtagtggaattccgagtgtagaggtgaaattcgtagatattcggaagaacaccagtggcgaaggcgactacctggccgtcgattgacgctcatgtgcgaaagcgtggggagcaaacaggattagataccctggtagtccacgccgtaaacgatgagtgctagttgttggggtgcatgcacctcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccagcctttgacatgggaactatgggcagaagagattttgtccttcacttcgggtgggttccacacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacagtgggtcgctaactcgcgagagtaagctaatctctaaaagccatctcagttcggattgttctctgcaactcgagagcatgaagtcggaatcgctagtaatcgtggatcagcatgccacggtgaatacgttcccgggccttgtacacaccgcccgtcacaccatgggagttggttttacccgaagccggtgagctaaccgcaaggaggcagccgaccacggtaaggtcagcgactggggtgaagtcgtaacaaggtagccgtaggggaacctgcggctggatcacctcctttcaagga

SEQ ID NO: 5174 - DNA, 1494 bp, Magnetospirillum sp. LBB-42
  ref <308>: DATABASE ACCESSION NUMBER: NCBI ACCESSION: NZ_PGTO01000047.1
  ref <309>: DATABASE ENTRY DATE: 2019-04-01
  ref <313>: RELEVANT RESIDUES IN SEQ ID NO: (1)..(1494)
gaagtcaacttgagagtttgatcctggctcagaacgaacgctggcggcaggcttaacacatgcaagtcgaacgaagtcttcggacttagtggcgcacgggtgagtaacacgtgggaatatacctctcagtgggggataacgtcgggaaactgacgctaataccgcatacgcccttcgggggaaagatttatcgctgagagattagcccgcgtccgattagctagttggtgaggtaacggctcaccaaggcgacgatcggtagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcgacggggacgatgatgacggtacccgtagaagaagccccggctaacttcgtgccagcagccgcggtaatacgaagggggctagcgttgttcggaattactgggcgtaaagcgcacgcaggcggtgatcatagtcagaagtgaaagccctgggctcaacccgggaattgcttttgatactgggtcactagaatcacggagagggtagtggaattccgagtgtagaggtgaaattcgtagatattcggaagaacaccagtggcgaaggcgactacctggccgtcgattgacgctcatgtgcgaaagcgtggggagcaaacaggattagataccctggtagtccacgctgtaaacgatgagtgctagttgttggggtgcatgcacctcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccagcccttgacatgggacgtatgttcaccagagatggtgtcttgccttcgggcgcgtccgcacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacagtgggtcgctaactcgcgagagtaagctaatccctaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaagccggtgagctaaccgcaaggaggcagccgaccacggtaaggtcagcgactggggtgaagtcgtaacaaggtagccgtaggggaacctgcggctggatcacctcctttcaagg

SEQ ID NO: 5175 - DNA, 1501 bp, Magnetospirillum sp. ME-1
  ref <308>: DATABASE ACCESSION NUMBER: NCBI ACCESSION: NZ_CP015848.1
  ref <309>: DATABASE ENTRY DATE: 2019-04-01
  ref <313>: RELEVANT RESIDUES IN SEQ ID NO: (1)..(1501)
gctttggaagtcaacttgagagtttgatcctggctcagaacgaacgctggcggcaggcttaacacatgcaagtcgaacgaagtcttcggacttagtggcgcacgggtgagtaacacgtgggaatatacctcttggtggggaataacatcgggaaactgatgctaataccgcatacgcccttcgggggaaagatttatcgccgagagattagcccgcgtccgattagctagttggtgaggtaatggctcaccaaggcgacgatcggtagctggtctgagaggatgatcagccacactgggactgagacacggcccagactcctacgggaggcagcagtggggaatattggacaatgggggaaaccctgatccagccatgccgcgtgagtgatgaaggccttagggttgtaaagctctttcacccacgacgatgatgacggtagtgggagaagaagccccggctaacttcgtgccagcagccgcggtaatacgaagggggctagcgttgttcggaattactgggcgtaaagcgcacgcaggcggtggtcatagtcagaagtgaaagccctgggctcaacccgggaattgcttttgatactggaccgctagaatcacggagagggtagtggaattccgagtgtagaggtgaaattcgtagatattcggaagaacaccagtggcgaaggcgactacctggccgtcgattgacgctcatgtgcgaaagcgtggggagcaaacaggattagataccctggtagtccacgccgtaaacgatgagtgctagttgttggggtgcatgcacctcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccagcccttgacatgggacgtatgtttgccagagatggtgacttgtcttcggacgcgtccgcacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacagtgggtcgctaactcgcgagagtatgctaatccctaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggctttacccgaagccggtgcgctaaccgcaaggaggcagccgaccacggtaaggtcagcgactggggtgaagtcgtaacaaggtagccgtaggggaacctgcggctggatcacctcctttcaagga

SEQ ID NO: 5176 - DNA, 1500 bp, Magnetospirillum sp. XM-1
  ref <308>: DATABASE ACCESSION NUMBER: NCBI ACCESSION: NZ_LN997848.1
  ref <309>: DATABASE ENTRY DATE: 2019-04-01
  ref <313>: RELEVANT RESIDUES IN SEQ ID NO: (1)..(1500)
gctttggaagtcaacttgagagtttgatcctggctcagaacgaacgctggcggcaggcttaacacatgcaagtcgaacgaagtcttcggacttagtggcgcacgggtgagtaacacgtgggaatatacctcttggtggggaataacatcgggaaactgatgctaataccgcatacgcccttcgggggaaagatttatcgccgagagattagcccgcgtccgattagctagttggtgaggtaatggctcaccaaggcgacgatcggtagctggtctgagaggatgatcagccacactgggactgagacacggcccagactcctacgggaggcagcagtggggaatattggacaatgggggaaaccctgatccagccatgccgcgtgagtgatgaaggccttagggttgtaaagctctttcacccacgacgatgatgacggtagtgggagaagaagccccggctaacttcgtgccagcagccgcggtaatacgaagggggctagcgttgttcggaattactgggcgtaaagcgcacgcaggcggtgatcatagtcagaagtgaaagccctgggctcaacccgggaattgcttttgatactggatcgctagaatcacggagagggtagtggaattccgagtgtagaggtgaaattcgtagatattcggaagaacaccagtggcgaaggcgactacctggccgtcgattgacgctcatgtgcgaaagcgtggggagcaaacaggattagataccctggtagtccacgccgtaaacgatgagtgctagttgttggggtgcatgcacctcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccagcccttgacatgggacgtatgtttgccagagatggtgacttgtcttcggacgcgtccacacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggtggggatgacgtcaagtcctcatggcccttacgggctgggctacacacgtgctacaatggtggtgacagtgggtcgctaactcgcgagagtatgctaatccctaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggctttacccgaagccggtgcgctaaccgcaaggaggcagccgaccacggtaaggtcagcgactggggtgaagtcgtaacaaggtagccgtaggggaacctgcggctggatcacctcctttcaagg

SEQ ID NO: 5177 - DNA, 1502 bp, Magnetovibrio blakemorei
  ref <308>: DATABASE ACCESSION NUMBER: NCBI ACCESSION: NZ_MCGG01000011.1
  ref <309>: DATABASE ENTRY DATE: 2019-04-01
  ref <313>: RELEVANT RESIDUES IN SEQ ID NO: (1)..(1502)
tcaacttgagagtttgatcctggctcagaacgaacgctggcggcatgcctaacacatgcaagttgaacgagaaagcggcttcggccgtgagtagagtggcgcacgggtgagtaacgcgtgggaacctgccaagcagtggggaataacctttggaaacgaaggctaataccgcatacgcccttcgggggaaagatttatcgctgtttgatggtcccgcgtccgattagctagttggtaaggtaatggcttaccaaggcgacgatcggtagctggtctgagaggatgatcagccacactggaactgagacacggtccagactcctacgggaggcagcagtggggaatattggacaatgggcgcaagcctgatccagcaatgccgcgtgagtgaagaaggccctagggttgtaaaactctttcagtagtgatgatgatgacagtaactacagaagaagcaccggctaacttcgtgccagcagccgcggtaatacgaagggtgctagcgttgttcggaattactgggcgtaaagagcatgtaggcggatagattagtcagaggtgaaagccccgagctcaacttgggaattgcctttgatactgtttatcttgagtccgagagagggtagtggaatttccagtgtagaggtgaaattcgtagatattggaaagaacaccagtggcgaaggcggctacctggctcggtactgacgctgagatgcgaaagcgtggggagcaaacaggattagataccctggtagtccacgccgtaaacgatgagtgctagctgttgggatcttaggtctcagtggcgcagctaacgcattaagcactccgcctggggagtacggtcgcaagattaaaactcaaaggaattgacgggggcccgcacaagcggtggagcatgtggtttaattcgaagcaacgcgaagaaccttaccagcccttgacataccgatcgcggttagtggagacactttccttcagttcggctggatcggatacaggtgctgcatggctgtcgtcagctcgtgtcgtgagatgttgggttaagtcccgcaacgagcgcaaccctcgcctttagttgccatcatttagttgggcactctagaggaactgccggtgacaagccggaggaaggtggggatgacgtcaagtcctcatggcccttacgggctgggctacacacgtgctacaatggcggtgacagtgggttgcgacctcgcgagaggtagccaatccctaaaaaccgtctcagttcggattgttctctgcaactcgagagcatgaagttggaatcgctagtaatcgcggatcagcatgccgcggtgaatacgttcccgggccttgtacacaccgcccgtcacaccatgggagttggttttacccgaaggcgatgcgctaaccgcaaggaggcagtcgaccacggtaaggtcagcgactggggtgaagtcgtaacaaggtagccgtaggggaacctgcggctggatcacctcctttcaagg

SEQ ID NO: 5178 - DNA, 1546 bp, Mahella australiensis
  ref <308>: DATABASE ACCESSION NUMBER: NCBI ACCESSION: NC_015520.1
  ref <309>: DATABASE ENTRY DATE: 2019-04-01
  ref <313>: RELEVANT RESIDUES IN SEQ ID NO: (1)..(1546)
aacaagagagtttgatcctggctcaggacgaacgctggcggcgtgcctaaaacatgcaagtcgaacggatatactaacattaagcgattaatgggagtatattagtggcggacgggtgagtaacacgtgaacaacctgccctgtacagggggataacagaccgaaaggactgctaataccccatgagaccacagcatcgcatgatgcgggggtcaaaggagcaatccggtataggaggggttcgcggcccattagctagttggtgagggtagaagcccaccaaggcgacgatgggtagccggcctgagagggtgaacggccacactgggactgagacacggcccagactcctacgggaggcagcagttggggatattgcgcaatgggcgaaagcctgacgcagcgacgccgcgtgagggaagaaggtcttcggattgtaaacctctgtcgagtgggaagaaagaaatgacagtaccactggaggaagccccggctaactacgtgccagcagccgcggtaatacgtagggggctagcgttgtccggaattactgggcgtaaagggcgtgtaggcggtagagcaagtcaggtgtgaaacccccgggctcaactcggggcatgcatctgaaactgcgatacttgagtgcaggagagggaagcggaatttctggtgtagcggtggaatgcgtagatatcaggaagaacaccggtggcgaaggcggctttctggcctgcaactgacgctgaggcgcgaaagcgtggggagcgaacaggattagataccctggtagtccacgctgtaaacgatggatactaggtgtaggtggtatcaaagccatctgtgccgaagttaacacattaagtatcccgcctggggagtacggccgcaaggttgaaactcaaaggaattgacgggggcccgcacaagcagcggagcgtgtggtttaattcgaagcaacgcgaagaaccttaccaggttttgacatgcatatgaattatgcagaaatgcatgaggcttatcgaaagataagacatatgcacaggtggtgcatggttgtcgtcagctcgtgtcgtgagatgttgggttaagtcccgcaacgagcgcaacccttattgttagttgccagcacgtagaggtgggcactctaacgagactgccgtggataacacggaggaaggtggggatgacgtcaaatcatcatgccccttatgatctgggctacacacgcgctacaatggccggaacaaagaggagcgaagcggtaacgcagagggaatctcaaaaaaccggtctcagttcagattgtgggctgcaacccgcccacatgaagaaggagttgctagtaatcgcggatcagcatgccgcggtgaatacgttcccgggccttgtacacaccgcccgtcacaccatgagagtctacaacaccttaagccggtgagctaaccgcaaggaggcagccgtccaaggtggggtagatgattggggtgaagtcgtaacaaggtagccgtatcggaaggtgcggctggatcacctcctttctaaggag

SEQ ID NO: 5179 - DNA, 1554 bp, Mailhella massiliensis
  ref <308>: DATABASE ACCESSION NUMBER: NCBI ACCESSION: NZ_LT706945.1
  ref <309>: DATABASE ENTRY DATE: 2019-04-01
  ref <313>: RELEVANT RESIDUES IN SEQ ID NO: (1)..(1554)
ttcaactggagagtttgattctggctcagattgaacgctggcggcgtgcctaacacatgcaagtcgtacgtgaaagggtcttcggacccgagtaaagtggcgcacgggtgagtaacacgtggataatctaccgggaagtgaggaataacagctggaaacggctgctaataccgcatgagcttcatatttatctatgaaggaaagggggcctctgcatatgcttccgcttttcgatgagtccgcgtcccattagctagttggtgaggtaatggcccaccaaggcgacgatgggtagctggtctaagaggatgatcagtcacattggaactggaacacggtccaaactcctacgggaggcagcagtggggaatattgcgcaatgggcgaaagcctgacgcagcgacgccgcgtgagggatgaaggtcttcggatcgtaaacctctgtcagaagggaagaacaagcactgtgccaatcagcagtgccctgacggtaccttcaaaggaagcaccggctaactccgtgccagcagccgcggtaatacggagggtgcaagcgttaatcggaattactgggcgtaaagcgcgtgtaggctgtatggcaagttggaggtgaaatcccacggctcaaccgtggaactgccttcaaaactaccaaactggagtgcgagagaggatagcggaattccaggtgtaggagtgaaatccgtagatatctggaagaacatcagtggcgaaggcggctatctggctcgtaactgacgctgagatgcgaaagcgtgggtagcaaacaggattagataccctggtagtccacgctgtaaacgatggatactagttgtcgggttgtatgactcggtgacgcagctaacgcaataagtatcccgcctggggagtacggtcgcaaggctgaaactcaaagaaattgacgggggcccgcacaagcggtggagtatgtggtttaattcgatgcaacgcgaagaaccttacccaggcttgacatctagggagcctctatgaaagtagagggtgctcttcggagaaccctaagacaggtgctgcatggctgtcgtcagctcgtgccgtgaggtgttgggttaagtcccgcaacgagcgcaacccctgtccttagttgccatcaggtaatgctgggcactctaaggagaccgcttcggttaacggagaggaaggtggggacgacgtcaagtcatcatggcccttacgcctggggctacacacgtactacaatggcgcatacaaagggaagcgagaccgcgaggtggagccaatctcaaaaaatgcgtcccagtccggacaggagtctgcaactcgactcctcgaagtcggaatcgctagtaattctggatcagcatgccagggtgaatgcgttcccgggccttgtacacaccgcccgtcacaccacgaaagtcggttttacccgaagccggtgagctaactagcaatagaagcagccgtctacggtaggcccgataattggggtgaagtcgtaacaaggcagccgtaggggaacctgcggctggatcacctccttttaga

SEQ ID NO: 5180 - DNA, 1542 bp, Maledivibacter halophilus
  ref <308>: DATABASE ACCESSION NUMBER: NCBI ACCESSION: NZ_FUZT01000039.1
  ref <309>: DATABASE ENTRY DATE: 2019-04-01
  ref <313>: RELEVANT RESIDUES IN SEQ ID NO: (1)..(1542)
ttttatttaagagtttgatcctggctcaggatgaacgctggcggcgtgcttaacacatgcaagtcgagcgagaaggctttaactaatccttcgggagaagatagagctggaaagcggcggacgggtgagtaacgcgtgggtaacctgccttgtacagagggatagccgccggaaacggtgattaatacctcataagaccacagtatcgcatgatacagtggccaaaattcaggtggtacaggatggacccgcgtctgattagctagttggcagggtaaaggcctaccaaggcgacgatcagtagccgacctgagagggtgatcggccacactggaactgagacacggtccagactcctacgggaggcagcagtggggaatattgcacaatgggggaaaccctgatgcagcaacgccgcgtgagcgaagaaggccttcgggtcgtaaagctctgtcctaagggaagaaaaatgacggtaccttaggaggaagccccggctaactacgtgccagcagccgcggtaatacgtagggggcgagcgttatccggaatcactgggcgtaaagggtgcgtaggcggccaggcaagccagaggttaaaggctacggcttaaccgtagtaagcctttggaactgtatggcttgagtgcaggagaggagagtggaattcctagtgtagcggtgaaatgcgtagatattaggaggaacaccagtggcgaaggcgactctctggactgcaactgacgctgaggcacgaaagcgtggggagcgaacaggattagataccctggtagtccacgccgtaaacgatgagtgctaggtgtcgggggttcacaccctcggtgccggagttaacgcattaagcactccgcctggggagtacggtcgcaagactgaaactcaaaggaattgacggggacccgcacaagcagcggagcatgtggtttaattcgaagcaacgcgaagaaccttaccaggacttgacatccctttgctaggtttgtaatggaacccttcccttcggggacaaaggagacaggtggtgcatggttgtcgtcagctcgtgtcgtgagatgttgggttaagtcccgcaacgagcgcaacccttgtttttagttgccatcaggtaaagctgggcactctaaagagactgccggtgataaaccggaggaaggtggggatgacgtcaaatcatcatgccccttatgttctgggctacacacgtgctacaatggctggtacaacgggcagctaaagagtaatctggagctaatcccaaaaagccagtcccagttcggattgtgggctgcaactcgcccatatgaagttggagttgctagtaatcgcggatcagaatgtcgcggtgaatgcgttcccgggtcttgtacacaccgcccgtcacaccatgggagcctagggcacccgaagtcagctatccaacttttaaagaggaagctgccgaaggtgaaataggtgactagggtgaagtcgtaacaaggtagccgtatcggaaggtgcggctggatcacctcctttctaagga

SEQ ID NO: 5181 - DNA, 1159 bp, Malonomonas rubra
  ref <308>: DATABASE ACCESSION NUMBER: NCBI ACCESSION: NZ_FQZT01000016.1
  ref <309>: DATABASE ENTRY DATE: 2019-04-01
  ref <313>: RELEVANT RESIDUES IN SEQ ID NO: (1)..(1159)
aaccctgacgcagcaacgccgcgtgaaggatgaaggcctttgggtcgtaaacttctgtcagtggggaagaaatgccagtaatggtgatgacggtacccgcaaaggaagcaccggctaactccgtgccagcagccgcggtaatacggagggtgcaagcgttgttcggaattattgggcgtaaagagcatgtaggcggactgttaagtctgatgtgaaagcccggggctcaaccccggaagtgcattggatactggcggtcttgagtatgggagaggaaagtggaattccgagtgtaggagtgaaatccgtagatattcggaggaacaccagtggcgaaggcggctttctggaccaatactgacgctgagatgcgaaagcgtggggagcgaacaggattagataccctggtagtccacgccgtaaacgatgaatactaggtgttgcgggtaaccactcctgcagtgccgcagctaacgcattaagtattccgcctggggagtacggccgcaaggctaaaactcaaaggaattgacgggggcccgcacaagcggtggagcatgtggtttaattcgacgcaacgcgaagaaccttacctgggtttgacatcccgatcgtacattatggaaacatagtggtcagttcggctggatcggtgacaggtgctgcatggctgtcgtcagctcgtgtcgtgagatgttgggttaagtcccgcaacgagcgcaacccttgtccttagttgccatcatttagttgggcactctagggagactgccggtgttaagccggaggaaggtggggatgacgtcaagtcctcatggcccttatatccagggctacacacgtgctacaatggccggtacaaagggcagcgataccgcgaggtggagctaatcccaaaaagccggtctcagttcggattggagtctgcaactcgactccatgaagttggaatcgctagtaatcgcgtatcagcatgacgcggtgaatacgttcccgggccttgtacacaccgcccgtcacaccacgggagtctattgtaccggaaaccggtgggccaaccttcgggaggcagccgtttatggtatgatcggtaactggggtgaagtcgtaacaaggtatccgtaccggaaggtgcggatggatcacctcctttctaagg

SEQ ID NO: 5182 - DNA, 1454 bp, Mameliella alba
  ref <308>: DATABASE ACCESSION NUMBER: NCBI ACCESSION: NZ_FMZI01000034.1
  ref <309>: DATABASE ENTRY DATE: 2019-04-01
  ref <313>: RELEVANT RESIDUES IN SEQ ID NO: (1)..(1454)
tcaacttgagagtttgatcctggctcagaacgaacgctggcggcaggcctaacacatgcaagtcgtgcgcgccttcgggtgagcggcggacgggtgagtaacgcgtgggaatgtgcccttctgttgaggatagccccgggaaactgggagtaatactcgatacgccctacgggggaaggaaggatcagcccgcgtctgattaggtagttggtggggtaatggcctaccaagcctacgatcagtagctggttttagaggatgatcagccacactgggactgagacacggcccagactcctacgggaggcagcagtggggaatcttagacaatgggggcaaccctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggatcagaaagttgggggtgaaatcccggggctcaaccccggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggcatctacagtgggttaatccccaaaagatgtctcagttcggattgttctctgcaactcgagagcatgaagtcggaatcgctagtaatcgcgtaacagcatgacgcggtgaatacgttcccgggccttgtacacaccgcccgtcacaccatgggagttggttctacctgacggccgtgcgctaaccttcgggaggcagcggaccacggtaggatcagcgactggggtgaagtcgtaacaaggtagccgtaggggaacctgcggctggatcacctcctttctaa

SEQ ID NO: 5183 - DNA, 1544 bp, Mannheimia granulomatis
  ref <308>: DATABASE ACCESSION NUMBER: NCBI ACCESSION: NZ_AVSP01000024.1
  ref <309>: DATABASE ENTRY DATE: 2019-04-01
  ref <313>: RELEVANT RESIDUES IN SEQ ID NO: (1)..(1544)
ttgaattgaagagtttgatcatggctcagattgaacgctggcggcaggcttaacacatgcaagtcgaacggtagcacaaaggagcttgctccttgggtgacgagtggcggacgggtgagtaatgcttgggaatctggcttatggagggggataactactggaaacggtagctaataccgcgtaatgtctaaggactaaagggtgggaccatttggccacctgccataagatgagcccaagtgggattaggtagttggtgaggtaaaggctcaccaagcccgcgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggtgattgttttaatagaacaatcaattgacgttaactacagaagaagcaccggctaactccgtgccagcagccgcggtaatacggggggtgcgagcgttaatcggaataactgggcgtaaagggcacgcaggcggacttttaagtgaggtgtgaaatccccgggcttaacctgggaattgcatttcagactgggagtctagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgccgtaaacgctgtcgatttggggattggggtttaactctggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccaaagaattctgcagagatgcggaagtgccttcgggaactttgagacaggtgctgcatggctgtcgtcagctcgtgttgtgaaatgttgggttaagtcccgcaacgagcgcaacccttatcctttgttgccagcgatttggtcgggaactcaaaggagactgccggtgataaaccggaggaaggtggggatgacgtcaagtcatcatggcccttacgagtagggctacacacgtgctacaatggcgtatacagagggcggcgacccagcgatggtgagcgaatctcagaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccgcaaggggggcgtttaccacggtatgattcatgactggggtgaagtcgtaacaaggtaaccgtaggggaacctgcggttggatcacctccttacc

SEQ ID NO: 5184 - DNA, 1544 bp, Mannheimia haemolytica
  ref <308>: DATABASE ACCESSION NUMBER: NCBI ACCESSION: NZ_LR134495.1
  ref <309>: DATABASE ENTRY DATE: 2019-04-01
  ref <313>: RELEVANT RESIDUES IN SEQ ID NO: (1)..(1544)
ttgaattgaagagtttgatcatggctcagattgaacgctggcggcaggcttaacacatgcaagtcgaacggtagcaggaagaagcttgcttctttgctgacgagtggcggacgggtgagtaatgcttgggaatctggcttatggagggggataactactggaaacggtagctaataccgcgtaatgtcttaggactaaagggtgggaccatttggccacctgccataagatgagcccaagtgggattaggtagttggtgaggtaaaggctcaccaagcccgcgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtgacgaggaaggcgactgttttaatagaacagtcgattgacgttaatcacagaagaagcaccggctaactccgtgccagcagccgcggtaatacggggggtgcgagcgttaatcggaataactgggcgtaaagggcacgcaggcggttgtttaagtgaggtgtgaaagccccgggcttaacctgggaattgcatttcagactggacaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgccgtaaacgctgtcgatttggggattgggctttaagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaaccttgtagagatacgagggtgccttcgggagctctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacagagggcggcgagccagcgatggggagcgaatctcagaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccgaaaggggggcgtttaccacggtatgattcatgactggggtgaagtcgtaacaaggtaaccgtaggggaacctgcggttggatcacctccttacc

SEQ ID NO: 5185 - DNA, 1544 bp, Mannheimia varigena
  ref <308>: DATABASE ACCESSION NUMBER: NCBI ACCESSION: NZ_CP030062.1
  ref <309>: DATABASE ENTRY DATE: 2019-04-01
  ref <313>: RELEVANT RESIDUES IN SEQ ID NO: (1)..(1544)
ttgaattgaagagtttgatcatggctcagattgaacgctggcggcaggcttaacacatgcaagtcgaacggtaacagggagaagcttgcttctttgctgacgagtggcggacgggtgagtaatgcttgggaatctggcttatggaggggggtaactactggaaacggtagctaataccgcgtaatgtctttggactaaagggtgggactttcgggccacctgccataagatgagcccaagtgggattagctagttggtgaggtaaaggctcaccaaggcgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggcagacttgttaatagcaagtttgattgacgttaactacagaagaagcaccggctaactccgtgccagcagccgcggtaatacggggggtgcaagcgttaatcggaataactgggcgtaaagggcacgcaggcggttacttaagtgagatgtgaaagccccgggcttaacctgggaattgcatttcatactgggtaactagagtattttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgccgtaaacgctgtcgatttggggattgggctttaagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaatcttgtagagatacgagagtgccttcgggaactttgagacaggtgctgcatggctgtcgtcagctcgtgttgtgaaatgttgggttaagtcccgcaacgagcgcaacccttatcctttgttgccagcgatttggtcgggaactcaaaggagactgccggtgataaaccggaggaaggtggggatgacgtcaagtcatcatggcccttacgagtagggctacacacgtgctacaatggcgtatacagagggcagcgacccagcgatggtgagcgaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggttggatcacctccttacc

SEQ ID NO: 5186 - DNA, 1515 bp, Marasmitruncus massiliensis
  ref <308>: DATABASE ACCESSION NUMBER: NCBI ACCESSION: NZ_FYDE01000005.1
  ref <309>: DATABASE ENTRY DATE: 2019-04-01
  ref <313>: RELEVANT RESIDUES IN SEQ ID NO: (1)..(1515)
taaacaaagagtttgatcctggctcaggacgaacgctggcggcgcgcctaacacatgcaagtcgaacggacagaagagaagcttgcttagcttctgttagtggcggacgggtgagtaacacgtgagtaacctgcctttcagagggggataacgattggaaacgatcgctaataccgcatgatgttgcgatgggacatcctattgcaaccaaaggagtaatccgctgaaagatgggctcgcggccgattagatagttggtgaggtaacggcccaccaagtcagcgatcggtagccggactgagaggttgatcggccacattgggactgagacacggcccagactcctacgggaggcagcagtgggggatattgcacaatggaggaaactctgatgcagcgacgccgcgtgagggaagacggtcttcggattgtaaacctctgtcttaggggaagaaaatgacggtaccctaagaggaagctccggctaactacgtgccagcagccgcggtaatacgtagggagcgagcgttgtccggaattactgggtgtaaagggagcgtaggcggggcagcaagttggatgtttaaactaccggcttaaccggtaactgcatccaaaactgcagttcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgctgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgtgcgcataccatagagatatgggaagcccttcggggcgcatagacaggtggtgcatggttgtcgtcagctcgtgtcgtgagatgttgggttaagtcccgcaacgagcgcaacccttattactagttgctacgcaagagcactctagtgagactgccgttgacaaaacggaggaaggtggggatgacgtcaaatcatcatgccccttatgacctgggctacacacgtactacaatggcacttaaacagagggctgctacatcgcgagatgaagcgaatcccgaaaaagtgtctcagttcggattgcaggctgcaactcgcctgcatgaagtcggaattgctagtaatcgcggatcagcatgccgcggtgaatacgttcccgggccttgtacacaccgcccgtcacaccatgggagtcggtaacacccgaagccagtagtctaaccgcaagggggacgctgtcgaaggtgggattgatgactggggtgaagtcgtaacaaggtagccgtatcggaaggtgcggctggatcacctcctttct

SEQ ID NO: 5187 - DNA, 975 bp, Maribacter sp. PoM-212
  ref <308>: DATABASE ACCESSION NUMBER: NCBI ACCESSION: NZ_QUSX01000007.1
  ref <309>: DATABASE ENTRY DATE: 2019-04-01
  ref <313>: RELEVANT RESIDUES IN SEQ ID NO: (1)..(975)
tattgggtttaaagggtccgtaggcgggccggtaagtcaggggtgaaagtctgtagctcaactatagaactgcctttgatactgccggtcttgagtcatggtgaagttggcggaatatgtggtgtagcggtgaaatgcatagatatcacatagaacaccgattgcgaaggcagctgactaaccatgtactgacgctgatggacgaaagcgtggggagcgaacaggattagataccctggtagtccacgccgtaaacgatggatactagctgtccgggtccttgagacctgggcggccaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgcattttgacagggccagagatggcctttccttcgggcaatttgcaaggtgctgcatggttgtcgtcagctcgtgccgtgaggtgtcaggttaagtcctataacgagcgcaacccctaccgttagttgccagcgagtcatgtcggggactctaacgggactgccggtgcaaaccgcgaggaaggtggggatgacgtcaaatcatcacggcccttacgtcctgggccacacacgtgctacaatggcaggtacagagagcagccacgtcgcaaggcggagcgaatctataaaacctgtcacagttcggatcggggtctgcaactcgaccccgtgaagctggaatcgctagtaatcggatatcagccatgatccggtgaatacgttcccgggccttgtacacaccgcccgtcaagccatggaagccgggagtgcctgaagtccgtcaccgcaaggagcggcctagggcaagatcggtaactagggctaagtcgtaacaaggtagccgtaccggaaggtgcggctggaacacctcctttctaga

SEQ ID NO: 5188 - DNA, 1534 bp, Maribacter vaceletii
  ref <308>: DATABASE ACCESSION NUMBER: NCBI ACCESSION: NZ_RBIQ01000001.1
  ref <309>: DATABASE ENTRY DATE: 2019-04-01
  ref <313>: RELEVANT RESIDUES IN SEQ ID NO: (1)..(1534)
caacgatgaagagtttgatcctggctcaggatgaacgctagcggcaggcctaacacatgcaagtcgaggggtaacagaggagcttgcttctgctgacgaccggcgcacgggtgcgcaccgcgtatggaacctaccttttacagagggatagcccagggaaacttggattaatacctcatggtatcattttttagcattattaaatgattaaagacttcggtcggtaaaagatggccatgcgtcccattagctagatggtaaggtaacggcttaccatggctacgatgggtaggggccctgagagggggatcccccacactggtactgagacacggaccagactcctacgggaggcagcagtgaggaatattggacaatggaggagactctgatccagccatgccgcgtgcaggaagaatgccctatgggtagtaaactgcttttatacaggaagaaaaaagagtacgtgtactctactgacggtactgtaagaataaggaccggctaactccgtgccagcagccgcggtaatacggagggtccgagcgttatccggaattattgggtttaaagggtccgtaggcgggtcaataagtcaggggtgaaagtttgcagctcaactgtaaaattgcctttgatactgttggtcttgagttatagtgaagttgccggaatatgtagtgtagcggtgaaatgcatagatattacatagaacaccgattgcgaaggcaggtgactaactatatactgacgctgatggacgaaagcgtggggagcgaacaggattagataccctggtagtccacgccgtaaacgatggatactagctgtccgagaccttgagtcttgggcggccaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtagattgacaggactagagatagtttttccttcgggcaatttacaaggtgctgcatggttgtcgtcagctcgtgccgtgaggtgtcaggttaagtcctataacgagcgcaacccctgccgttagttgccagcatgttaagatggggactctaacgggactgccggtgcaaaccgtgaggaaggtggggatgacgtcaaatcatcacggcccttacgtcctgggccacacacgtgctacaatggtcggtacagagagcagccatgttgcaagacagagcgaatctataaaaccgatcacagttcggatcggggtctgcaactcgaccccgtgaagctggaatcgctagtaatcggatatcagccatgatccggtgaatacgttcccgggccttgtacacaccgcccgtcaagccatggaagccgggagtgcctgaagtccgtcaccgtaaggagcggcctagggcaagatcggtaactagggctaagtcgtaacaaggtagccgtaccggaaggtgcggctggaacacctcctttctaga

SEQ ID NO: 5189 - DNA, 1467 bp, Maribius pelagius
  ref <308>: DATABASE ACCESSION NUMBER: NCBI ACCESSION: NZ_FOCM01000009.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgcaccttcgggtgagcggcggacgggttagtaacgcgtgggaatatgcccatccctacggaatagcctcgggaaactgagagtaataccgtatacgcccttcgggggaaagattcatcggggatggattagcccgcgtctgattagatagttggtggggtaacggcctaccaagtcgacgatcagtagctggtttgagaggatgatcagcaacactgggactgagacacggcccagactcctacgggaggcagcagtggggaatcttagacaatgggcgcaagcctgatctagccatgccgcgtgagtgacgaaggccctagggtcgtaaagctctttcgccggggaagataatgactgtacccggtaaagaagtcccggctaactccgtgccagcagccgcggtaatacggaggggactagcgttgttcggaattactgggcgtaaagcgcgcgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatagatatcgtactttccagagatggatcggtcagttcggctggatatcatacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggcatctacagcgggttaatcccgaaaagatgtctcagttcggattgtcgtctgcaactcgacggcatgaagtcggaatcgctagtaatcgcggaacagcatgccgcggtgaatacgttcccgggccttgtacacaccgcccgtcacaccatgggagttggttctacccgacgacgctgtgctaaccttcgggaggcaggcggccacggtaggatcagcgactggggtgaagtcgtaacaaggtagccgtaggggaacctgcggctggatcacctcctttctaa

SEQ ID NO: 5190 - DNA, 1467 bp, Maribius salinus
  ref <308>: DATABASE ACCESSION NUMBER: NCBI ACCESSION: NZ_FQZA01000024.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcctaacacatgcaagtcgagcgcaccttcgggtgagcggcggacgggttagtaacgcgtgggaatatgcccatccctacggaatagcctcgggaaactgagagtaataccgtatacgcccttcgggggaaagatttatcggggatggattagcccgcgtctgattagatagttggtggggtaacggcctaccaagtcgacgatcagtagctggtttgagaggatgatcagcaacactgggactgagacacggcccagactcctacgggaggcagcagtggggaatcttagacaatgggcgcaagcctgatctagccatgccgcgtgagtgacgaaggccctagggtcgtaaagctctttcgccggggaagataatgactgtacccggtaaagaagtcccggctaactccgtgccagcagccgcggtaatacggaggggactagcgttgttcggaattactgggcgtaaagcgcgcgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatagatatcgtactttccagagatggatcggtcagttcggctggatatcatacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggcatctacagcgggttaatcccgaaaagatgtctcagttcggattgtcgtctgcaactcgacggcatgaagtcggaatcgctagtaatcgcggaacagcatgccgcggtgaatacgttcccgggccttgtacacaccgcccgtcacaccatgggagttggttctacccgacgacgctgtgctaaccttcggggggcaggcggccacggtaggatcagcgactggggtgaagtcgtaacaaggtagccgtaggggaacctgcggctggatcacctcctttctaa

SEQ ID NO: 5191 - DNA, 1468 bp, Maribius sp. MOLA 401
  ref <308>: DATABASE ACCESSION NUMBER: NCBI ACCESSION: NZ_JQEY01000008.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgagcgcaccttcgggtgagcggcggacgggtgagtaacgcgtgggaacgtgcccttctctgcggaatagcctcgggaaactgagagtaataccgcatacgcccttcgggggaaagatttatcggagaaggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggggaaaccctgatctagccatgccgcgtgagtgacgaaggtcttaggatcgtaaagctctttcgctggggaagataatgactgtacccagtaaagaagtcccggctaactccgtgccagcagccgcggtaatacggaggggactagcgttgttcggaattactgggcgtaaagcgcgcgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggttatcgtactttccagagatggatcggtcagttcggctggataacacacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggtggtgacagtgggttaatccctaaaaaccatctcagttcggattgtcgtctgcaactcgacggcatgaagtcggaatcgctagtaatcgtggaacagcatgccacggtgaatacgttcccgggccttgtacacaccgcccgtcacaccatgggagttggttctacctgacgacggtgcgctaacccttcggggaggcagccggccacggtaggatcagcgactggggtgaagtcgtaacaaggtagccgtaggggaacctgcggctggatcacctcctttctaa

SEQ ID NO: 5192 - DNA, 1471 bp, Maricaulis maris
  ref <308>: DATABASE ACCESSION NUMBER: NCBI ACCESSION: NZ_RBIM01000011.1
  ref <309>: DATABASE ENTRY DATE: 2019-04-01
  ref <313>: RELEVANT RESIDUES IN SEQ ID NO: (1)..(1471)
caacttgagagtttgattctggctcagaacgaacgctggcggcaggcttaacacatgcaagtcgagcgccctgcttgcagggagcggcagacgggtgagtaacgcgtgggaacgtgcctattggttcggaatagccccgggaaactgggtgtaataccgaatgtgcccttcgggggaaagatttatcgccaatagatcggcccgcgttagattagctagttggtggggtaaaagcctaccaaggctacgatctatagctggtctgagaggatgatcagccacactgggactgagacacggcccagactcctacgggaggcagcagtgaggaatcttggacaatgggggaaaccctgatccagccatgccgcgtgaatgatgaaggccttagggttgtaaaattctttcagcagggaagataatgacggtacctgcagaagaagccccggctaactccgtgccagcagccgcggtaatacggagggggctagcgttgttcggaattactgggcgtaaagcgctcgtaggcggattggtcagtcagaggtgaaagcccagggctcaaccttggaattgcctttgatactgccagtcttgagttcgggagaggtgagcggaattccgagtgtagaggtgaaattcgtagatattcggaggaacaccagaggcgaaggcggctcactggaccgatactgacgctgaggagcgaaagcgtggggagcaaacaggattagataccctggtagtccacgccgtaaacgatgagagctagttgtctggcagcatgctgttaggtgacgcagctaacgcattaagctctccgcctggggagtacggccgcaaggttaaaactcaaagaaattgacgggggcccgcacaagcggtggagcatgtggtttaattcgaagcaacgcgcagaaccttacctacccttgacataccaatcgcgatttccagagatggatttcttcagttcggctggattggatacaggtgctgcatggctgtcgtcagctcgtgtcgtgagatgttgggttaagtcccgcaacgagcgcaaccctcgccgttagttgccagcaggtttggctgggcactctaacgggaccgccggtgtcaagccggaggaaggtggggatgacgtcaagtcctcatggcccttacgggtagggctacacacgtgctacaatggcagtgacagagagctaatctctaaaaactgtctcagttcggattgtcttctgcaactcgaaggcatgaagttggaatcgctagtaatcgcggatcagcatgccgcggtgaatacgttcccgggccttgtacacaccgcccgtcacaccatgggagttggttctacccgaagatggtgcgctaaccttttggaagcagccagccacggtaggatcagcgactggggtgaagtcgtaacaaggtagccgtaggggaacctgcggctggatcacctcctttctaa

SEQ ID NO: 5193 - DNA, 1471 bp, Maricaulis sp. W15; identical to SEQ ID NO: 5192
  ref <308>: DATABASE ACCESSION NUMBER: NCBI ACCESSION: NZ_LQXG01000015.1
  ref <309>: DATABASE ENTRY DATE: 2019-04-01
  ref <313>: RELEVANT RESIDUES IN SEQ ID NO: (1)..(1471)

SEQ ID NO: 5194 - DNA, 1529 bp, Marichromatium sp. AB31
  ref <308>: DATABASE ACCESSION NUMBER: NCBI ACCESSION: NZ_RHFI01000046.1
  ref <309>: DATABASE ENTRY DATE: 2019-04-01
  ref <313>: RELEVANT RESIDUES IN SEQ ID NO: (1)..(1529)
gaactgaagagtttgatcctggctcagattgaacgctggcggcatgcctaacacatgcaagtcgaacgcgaaaccccttcggggggagtagagtggcggacgggtgagtaatgtgtgggaatctgccctgcagcgggggataacccggggaaactcgggctaataccgcatacgacctacgggtgaaagggggcttcggctctcactgcaggatgagcccacatccgattagcttgttggtgaggtaacggctcaccaaggcgacgatcggtagctggtctgagaggatgatcagccacactgggactgagacacggcccagactcctacgggaggcagcagtggggaatattggacaatgggcgaaagcctgatccagcaatgccgcgtgtgtgaagaaggcctgcgggttgtaaagcactttcagcgaggaagaaaagcctgtggttaatacccatgggtcttgacgttactcgcagaagaagcaccggctaactccgtgccagcagccgcggtaatacggagggtgcaagcgttaatcggaatcactgggcgtaaagcgcacgtaggcggcgaggtcagtcagatgtgaaagccccgggcttaacctgggaactgcatttgatactgcctggctagagtttgatagaggggggtggaattccaggtgtagcggtgaaatgcgtagatatctggaggaacaccagtggcgaaggcggccccctggatcaaaactgacgctgaggtgcgaaagcgtggggagcaaacaggattagataccctggtagtccacgccgtaaacgatgtcgactagccgttgggctcatttaagggtttagtggcgcagctaacgcgataagtcgaccgcctggggagtacggccgcaaggttaaaactcaaaggaattgacgggggcccgcacaagcggtggagcatgtggtttaattcgatgcaacgcgaagaaccttaccagcccttgacatcctcggaacttggcagagatgccttggtgccttcgggagccgagtgacaggtgctgcatggctgtcgtcagctcgtgtcgtgagatgttgggttaagtcccgtaacgagcgcaacccttgtccttagttgccagcacgtcatggtgggaactctaaggagactgccggtgataaaccggaggaaggtggggatgacgtcaagtcatcatggcccttatgggctgggctacacacgtgctacaatggtcggtacagagggttgcaaagcggcgacgtggagctaatctcagaaaaccggtcgtagtccggattgcagtctgcaactcgactgcatgaagtcggaatcgctagtaatcgcgaatcagaatgtcgcggtgaatacgttcccgggccttgtacacaccgcccgtcacaccatgggagttggttgcaccagaagtagatagcttaaccttcgggagggcgtttaccacggtgtgatcaatgactggggtgaagtcgtaacaaggtagccgtaggggaacctgcggctggatcacctcctta

SEQ ID NO: 5195 - DNA, 1531 bp, Marichromatium sp. AB32
  ref <308>: DATABASE ACCESSION NUMBER: NCBI ACCESSION: NZ_RHFJ01000062.1
  ref <309>: DATABASE ENTRY DATE: 2019-04-01
  ref <313>: RELEVANT RESIDUES IN SEQ ID NO: (1)..(1531)
gaactgaagagtttgatcctggctcagattgaacgctggcggcatgcctaacacatgcaagtcgaacgcgaaaccccttcggggggagtagagtggcggacgggtgagtaatgtgtgggaatctgccctgcagcgggggataacccggggaaactcgggctaataccgcatacgacctacgggtgaaagggggcttcggctctcactgcaggatgagcccacatccgattagcttgttggtgaggtaacggctcaccaaggcgacgatcggtagctggtctgagaggatgatcagccacactgggactgagacacggcccagactcctacgggaggcagcagtggggaatattggacaatgggcgaaagcctgatccagcaatgccgcgtgtgtgaagaaggcctgcgggttgtaaagcactttcagcgaggaagaaaagcctgtggttaatacccatgggtcttgacgttactcgcagaagaagcaccggctaactccgtgccagcagccgcggtaatacggagggtgcaagcgttaatcggaatcactgggcgtaaagcgcacgtaggcggcgaggtcagtcagatgtgaaagccccgggcttaacctgggaactgcatttgatactgcctggctagagtttgatagaggggggtggaattccaggtgtagcggtgaaatgcgtagatatctggaggaacaccagtggcgaaggcggccccctggatcaaaactgacgctgaggtgcgaaagcgtggggagcaaacaggattagataccctggtagtccacgccgtaaacgatgtcgactagccgttgggctcatttaagggtttagtggcgcagctaacgcgataagtcgaccgcctggggagtacggccgcaaggttaaaactcaaaggaattgacgggggcccgcacaagcggtggagcatgtggtttaattcgatgcaacgcgaagaaccttaccagcccttgacatcctcggaacttggcagagatgccttggtgccttcgggagccgagtgacaggtgctgcatggctgtcgtcagctcgtgtcgtgagatgttgggttaagtcccgtaacgagcgcaacccttgtccttagttgccagcacgtcatggtgggaactctaaggagactgccggtgataaaccggaggaaggtggggatgacgtcaagtcatcatggcccttatgggctgggctacacacgtgctacaatggtcggtacagagggttgcaaagcggcgacgtggagctaatctcagaaaaccggtcgtagtccggattgcagtctgcaactcgactgcatgaagtcggaatcgctagtaatcgcgaatcagaatgtcgcggtgaatacgttcccgggccttgtacacaccgcccgtcacaccatgggagttggttgcaccagaagtagatagcttaaccttcgggagggcgtttaccacggtgtgatcaatgactggggtgaagtcgtaacaaggtagccgtaggggaacctgcggctggatcacctccttact

SEQ ID NO: 5196 - DNA, 1460 bp, Marinibacterium profundimaris
  ref <308>: DATABASE ACCESSION NUMBER: NCBI ACCESSION: NZ_AQQR01000048.1
  ref <309>: DATABASE ENTRY DATE: 2019-04-01
  ref <313>: RELEVANT RESIDUES IN SEQ ID NO: (1)..(1460)
tcaacttgagagtttgatcctggctcagaacgaacgctggcggcaggcctaacacatgcaagtcgagcggaccttcgggtgagcggcggacgggttagtaacgcgtgggaacgtacccagatctgcggaatagccactggaaacggtgagtaataccgcatacgcccttcgggggaaagatttatcggatttggatcggcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgccagggaagataatgacggtacctggtaaagaaaccccggctaactccgtgccagcagccgcggtaatacggagggggttagcgttgttcggaattactgggcgtaaagcgcgcgtaggcggactattaagtcgagggtgaaatcccggggctcaaccccggaactgccttcgatactggtagtcttgaggtcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggacaactccagagatggagcctcccttcggggcctagtgacaggtgctgcatggctgtcgtcagctcgtgtcgtgagatgttcggttaagtccggcaacgagcgcaacccacacccttagttgccagcctttagttgggcactctaggggaactgcccgtgataagcgggaggaaggtgtggatgacgtcaagtcctcatggcccttacgggttgggctacacacgtgctacaatggcatctacagtgggttaatcccaaaaagatgtctcagttcggattgtcgtctgcaactcgacggcatgaagtcggaatcgctagtaatcgcgtaacagcatgacgcggtgaatacgttcccgggccttgtacacaccgcccgtcacaccatgggagttgggtctacccgaaggccgtgcgctaacttttgaggcagcggaccacggtaggctcagcgactggggtgaagtcgtaacaaggtagccgtaggggaacctgcggctggatcacctcctttctaa

SEQ ID NO: 5197 - DNA, 1470 bp, Marinicauda sp. WD6-1
  ref <308>: DATABASE ACCESSION NUMBER: NCBI ACCESSION: NZ_QEXV01000003.1
  ref <309>: DATABASE ENTRY DATE: 2019-04-01
  ref <313>: RELEVANT RESIDUES IN SEQ ID NO: (1)..(1470)
caagctgagagtttgattctggctcagaacgaacgctggcggcaggcttaacacatgcaagtcgagcgcgtccttcgggacgagcggcagacgggtgagtaacgcgtgggaacgtaccttccggttcggaatagccccgggaaactgggattaataccgaatacgccccaagggggaaagatttatcgccggatgatcggcccgcgtcagattagctagttggtggggtaacggcctaccaaggctgcgatctgtagctggtttgagaggatgatcagccacactgggactgagacacggcccagactcctacgggaggcagcagtggggaatcttggacaatgggcgcaagcctgatccagccatgccgcgtggatgaagaaggccctagggttgtaaaatcctttcagcggggaagataatgacggtacccgcagaagaagccccggctaactccgtgccagcagccgcggtaatacggagggggctagcgttgttcggaattactgggcgtaaagcgcgcgtaggcggaccagccagtcagaggtgaaagcccggagctcaactccggaattgcctttgatactgttggtctggagtccgggagaggtgtgtggaattccgagtgtagaggtgaaattcgtagatattcggaggaacaccagaggcgaaggcgacacactggaccggtactgacgctgaggcgcgaaagcgtggggagcaaacaggattagataccctggtagtccacgccgtaaacgatggatgctagttgtcgggcagcatgctgttcggtgacgcagctaacgcattaagcatcccgcctggggagtacggccgcaaggttaaaactcaaagaaattgacgggggcccgcacaagcggtggagcatgtggtttaattcgaagcaacgcgaagaaccttacctgcccttgacatcccggtcgcggtttggggagacccaatccttcagttcggctggaccggtgacaggtgctgcatggctgtcgtcagctcgtgtcgtgagatgttgggttaagtcccgcaacgagcgcaaccctcgccgttagttgccagcaggtttggctgggcactctaacgggactgccggtgtcaaaccggaggaaggtggggatgacgtcaagtcctcatggcccttacgggcagggctacacacgtgctacaatggcggtgacagagggataatccctaaaaaccgtctcagttcggattgtcttctgcaactcgaaggcatgaagttggaatcgctagtaatcgcggatcagcatgccgcggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttcta

SEQ ID NO: 5198 - DNA, 1467 bp, Marinicaulis flavus
  ref <308>: DATABASE ACCESSION NUMBER: NCBI ACCESSION: NZ_PJCH01000003.1
  ref <309>: DATABASE ENTRY DATE: 2019-04-01
  ref <313>: RELEVANT RESIDUES IN SEQ ID NO: (1)..(1467)
caacttgagagtttgatcctggctcaggacgaacgctggcggcaggcttaacacatgcaagtcgagcgccctgcttgcagggagcggcagacgggtgagtaacgcgtgggaacgtgcccttcggtacggaatagccccgggaaactgggtgtaataccgtatacgacctccgggtgaaagatttatcgccgaaggatcggcccgcgttagattagcttgatggtggggtaaaggcctaccatggcgacgatctatagctggtctgagaggacgaccagccacactgggactgagacacggcccagactcctacgggaggcagcagtggggaatattggacaatgggcgaaagcctgatccagccatgccgcgtggatgaagaaggccctagggttgtaaagtcctttcaacggtgaagataatgacggtaaccgtagaagaagccccggctaatttcgtgccagcagccgcggtaatacgaaaggggctagcgttgttcggaattactgggcgtaaagcgcacgtaggcggcaatgtaagttagaggtgaaatcccggagctcaactccggaactgcctttaaaactacatagctagaggatgtgagaggatagtggaattccgagtgtagaggtgaaattcgtagatattcggaagaacaccagtggcgaaggcgactgtctggcacatttctgacgctgaggtgcgaaagcgtggggagcaaacaggattagataccctggtagtccacgccgtaaacgatgaaggctagttgtcgggcggcatgccgttcggtgacgcagttaacgcattaagccttccgcctggggagtacggtcgcaagattaaaactcaaaggaattgacgggggcccgcacaagcggtggagcatgtggtttaattcgaagcaacgcgaagaaccttaccagcccttgacatcgggatcgcgcggaccagagatggaccgtttcagttcggctggatccctgacaggtgttgcatggctgtcgtcagctcgtgtcgtgagatgttgggttaagtcccgcaacgagcgcaaccctcgctgttagttgccagcatttagttgggcactctagcggtaccgccggtgataagccggaggaaggtggggatgacgtcaagtcatcatggcccttacgggctgggctacacacgtgctacaatggcgaccataatgggataatccccaaaagtcgtctcagttcggattgtctgctgcaactcgcaggcatgaagttggaatcgctagtaatcgtggatcagcatgccacggtgaatacgttcccgggccttgtacacaccgcccgtcacaccatgggagttggttctacccgaagactgtgcgctaacttttgaggcagcaggccacggtagggtcagcgactggggtgaagtcgtaacaaggtagccgtaggggaacctgcggctggatcacctcctttctaa

SEQ ID NO: 5199 - DNA, 1520 bp, Mariniflexile sp. TRM1-10
  ref <308>: DATABASE ACCESSION NUMBER: NCBI ACCESSION: NZ_CP022985.1
  ref <309>: DATABASE ENTRY DATE: 2019-04-01
  ref <313>: RELEVANT RESIDUES IN SEQ ID NO: (1)..(1520)
aacgatgaagagtttgatcctggctcaggatgaacgctagcggcaggcctaacacatgcaagtcgaggggtagagggagcttgctcccttgagaccggcgcacgggtgcgtaacgcgtatacaacctgcctcttactgcgggatagcccagagaaatttggattaacaccgcatagtatagttacttggcatcaagttattattaaaggttacggtaagagatgggtatgcgttctattagctagatggagtggtaacggcacaccatggcaacgatagataggggccctgagagggggatcccccacactggtactgagacacggaccagactcctacgggaggcagcagtgaggaatattggacaatgggggcaaccctgatccagccatgccgcgtgcaggaagactgccctatgggttgtaaactgcttttgtacgggaagaaacactgccacgtgtggcagcttgacggtaccgtaagaataaggatcggctaactccgtgccagcagccgcggtaatacggaggatccaagcgttatccggaatcattgggtttaaagggtccgtaggtggatggttaagtcagaggtgaaatcctgcagctcaactgtagaattgcctttgatactggctatcttgaatcaatgtgaagtggttagaatatgtagtgtagcggtgaaatgcatagatattacatagaataccaattgcgaaggcagatcactaacattgcattgacactgatggacgaaagcgtggggagcgaacaggattagataccctggtagtccacgccgtaaacgatggatactagctgttcgggtttacctgagtggctaagcgaaagtgataagtatcccacctggggagtacgggcgcaagcctgaaactcaaaggaattgacgggggcccgcacaagcggtggagcatgtggtttaattcgatgatacgcgaggaaccttaccagggcttaaatgtaagttgcattagctggagacagctatttcttcggaccacttacaaggtgctgcatggttgtcgtcagctcgtgccgtgaggtgtcaggttaagtcctataacgagcgcaacccctgttgttagttgccagcgagtcaagtcgggaactctagcaagactgccagtgcaaactgtgaggaaggtggggatgacgtcaaatcatcacggcccttacgtcctgggctacacacgtgctacaatggtagggacagagagcagccactgggcgaccaggagcgaatctacaaaccctatcacagttcggatcggagtctgcaactcgactccgtgaagctggaatcgctagtaatcgcatatcagccatgatgcggtgaatacgttcccgggccttgtacacaccgcccgtcaagccatggaagctgggagtgcctgaagtccgtcaccgcaaggagcggcctagggtaaaatcggtaactagggctaagtcgtaacaaggtagccgtaccggaaggtgcggctggaacacctcctttctaga

SEQ ID NO: 5200 - DNA, 1556 bp, Marinilactibacillus piezotolerans
  ref <308>: DATABASE ACCESSION NUMBER: NCBI ACCESSION: NZ_FWDP01000004.1
  ref <309>: DATABASE ENTRY DATE: 2019-04-01
  ref <313>: RELEVANT RESIDUES IN SEQ ID NO: (1)..(1556)
aacgagagtttgatcctggctcaggacgaacgctggcggtatgcctaatacatgcaagtcgaacgatgaagctctctgcttgcagagagtggattagtggcgaacgggtgagtaacacgtgggtaacctgcccataagagggggataacatccggaaacggatgctaataccgcataggtctttgagacgcctgtctcttagatgaaaggtggcttcggctgccgcttatggatggacccgcggcgtattagctagttggtgaggtaatggctcaccaaggctgtgatacgtagccgacctgagagggtgatcggccacactgggactgagacacggcccagactcctacgggaggcagcagtagggaatcttccacaatgggtgcaaacctgatggagcaataccgcgtgagtgaagaaggtcttcggatcgtaaagctctgttgttagagaagaacaagccgggtagtaactgccccggccttgacggtatctaaccagaaagtcacggctaactacgtgccagcagccgcggtaatacgtaggtgacaagcgttgtccggatttattgggcgtaaagcgagcgcaggcggtcttttaagtctgatgtgaaagcccacggctcaaccgtggagggtcattggaaactggaagacttgaatgcagaagaggaaagtggaattccatgtgtagcggtgaaatgcgtagatatatggaggaacaccagtggcgaaggcgactttctggtctgtaattgacgctgaggctcgaaagcgtggggagcgaacaggattagataccctggtagtccacgccgtaaacgatgagtgctaagtgttggagggtttccgcccttcagtgctggagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctctgaccactctagagatagagccttcccttcggggacagagtgacaggtggtgcatggttgtcgtcagctcgtgtcgtgagatgttgggttaagtcccgtaacgagcgcaacccctattgttagttgccagcattcagttgggcactctagcgagactgccggtgataaaccggaggaaggcggggatgacgtcaaatcatcatgccccttatgacctgggctacacacgtgctacaatggatggtacaacgagttgcgagaccgcgaggtttagctaatctcctaaagccattctcagttcggattgcaggctgcaactcgcctgcatgaagctggaatcgctagtaatcgcggatcagaacgccgcggtgaatacgttcccgggtcttgtacacaccgcccgtcacaccacgagagtctgtaacacccgaagtcggtcgggtaacccttttgggagccagccgccgaaggtgggatggatgattggggtgaagtcgtaacaaggtagccgtatcggaaggtgcggctggatcacctcctttctaagga

SEQ ID NO: 5201 - DNA, 1556 bp, Marinilactibacillus psychrotolerans
  ref <308>: DATABASE ACCESSION NUMBER: NCBI ACCESSION: NZ_FUKW01000016.1
  ref <309>: DATABASE ENTRY DATE: 2019-04-01
  ref <313>: RELEVANT RESIDUES IN SEQ ID NO: (1)..(1556)
aacgagagtttgatcctggctcaggacgaacgctggcggtatgcctaatacatgcaagtcgaacgatgaaatcctctgcttgcagaggatggattagtggcgaacgggtgagtaacacgtgggtaacctgcccataagagggggataacattcggaaacggatgctaataccgcatatctcttcgagacgcctgtctcttagatgaaaggtggcttcggctgccgcttatggatggacccgcggcgtattagctagttggtgaggtaatggctcaccaaggctgtgatacgtagccgacctgagagggtgatcggccacactgggactgagacacggcccagactcctacgggaggcagcagtagggaatcttccacaatgggtgaaaacctgatggagcaataccgcgtgagtgaagaaggtcttcggatcgtaaagctctgttgttagagaagaataagtcgggtagtaactgccccggccttgacggtatctaaccagaaagtcacggctaactacgtgccagcagccgcggtaatacgtaggtgacaagcgttgtccggatttattgggcgtaaagcgagcgcaggcggtcttttaagtctgatgtgaaagcccacggctcaaccgtggagggtcattggaaactggaagacttgaatgcagaagaggaaagtggaattccatgtgtagcggtgaaatgcgtagatatatggaggaacaccagtggcgaaggcgactttctggtctgtaattgacgctgaggctcgaaagcgtggggagcgaacaggattagataccctggtagtccacgccgtaaacgatgagtgctaagtgttggagggtttccgcccttcagtgctggagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctctgaacactctagagatagagctttcccttcggggacagagtgacaggtggtgcatggttgtcgtcagctcgtgtcgtgagatgttgggttaagtcccgtaacgagcgcaacccctattgttagttgccagcattcagttgggcactctagcgagactgccggtgataaaccggaggaaggcggggatgacgtcaaatcatcatgccccttatgacctgggctacacacgtgctacaatggatggtacaacgagttgcgagaccgcgaggtttagctaatctcctaaagccattctcagttcggattgcaggctgcaactcgcctgcatgaagctggaatcgctagtaatcgcggatcagaacgccgcggtgaatacgttcccgggtcttgtacacaccgcccgtcacaccacgagagtctgtaacacccgaagtcggtagggtaacccttttgggagccagccgccgaaggtgggatggatgattggggtgaagtcgtaacaaggtagccgtatcggaaggtgcggctggatcacctcctttctaagga

SEQ ID NO: 5202 - DNA, 1556 bp, Marinilactibacillus sp. 15R
  ref <308>: DATABASE ACCESSION NUMBER: NCBI ACCESSION: NZ_CP017761.1
  ref <309>: DATABASE ENTRY DATE: 2019-04-01
  ref <313>: RELEVANT RESIDUES IN SEQ ID NO: (1)..(1556)
aacgagagtttgatcctggctcaggacgaacgctggcggtatgcctaatacatgcaagtcgaacgatgaaattctctgcttgcagagaatggattagtggcgaacgggtgagtaacacgtgggtaacctgcccataagagggggataacattcggaaacggatgctaataccgcataggtctttgagacgcctgtctcttagatgaaaggtggcttcggctgccgcttatggatggacccgcggcgtattagctagttggtgaggtaatggctcaccaaggctgtgatacgtagccgacctgagagggtgatcggccacactgggactgagacacggcccagactcctacgggaggcagcagtagggaatcttccacaatgggtgaaaacctgatggagcaataccgcgtgagtgaagaaggtcttcggatcgtaaagctctgttgttagagaagaacaagtcgggtagtaactgccccggccttgacggtatctaaccagaaagtcacggctaactacgtgccagcagccgcggtaatacgtaggtgacaagcgttgtccggatttattgggcgtaaagcgagcgcaggcggtcttttaagtctgatgtgaaagcccacggctcaaccgtggagggtcattggaaactggaagacttgaatgcagaagaggaaagtggaattccatgtgtagcggtgaaatgcgtagatatatggaggaacaccagtggcgaaggcgactttctggtctgtaattgacgctgaggctcgaaagcgtggggagcgaacaggattagataccctggtagtccacgccgtaaacgatgagtgctaagtgttggagggtttccgcccttcagtgctggagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctctgaacactctagagatagagctttcccttcggggacagagtgacaggtggtgcatggttgtcgtcagctcgtgtcgtgagatgttgggttaagtcccgtaacgagcgcaacccctattgttagttgccagcattcagttgggcactctagcgagactgccggtgataaaccggaggaaggcggggatgacgtcaaatcatcatgccccttatgacctgggctacacacgtgctacaatggatggtacaacgagttgcgagaccgcgaggtttagctaatctcctaaagccattctcagttcggattgcaggctgcaactcgcctgcatgaagctggaatcgctagtaatcgcggatcagaacgccgcggtgaatacgttcccgggtcttgtacacaccgcccgtcacaccacgagagtctgtaacacccgaagtcggtagggtaacccttttgggagccagccgccgaaggtgggatggatgattggggtgaagtcgtaacaaggtagccgtatcggaaggtgcggctggatcacctcctttctaagga

SEQ ID NO: 5203 - DNA, 1536 bp, Marinimicrobium koreense
  ref <308>: DATABASE ACCESSION NUMBER: NCBI ACCESSION: NZ_RJUK01000005.1
  ref <309>: DATABASE ENTRY DATE: 2019-04-01
  ref <313>: RELEVANT RESIDUES IN SEQ ID NO: (1)..(1536)
taaactgaagagtttgatcatggctcagattgaacgctggcggcaggcctaacacatgcaagtcgagcgagaaagcccttcggggtgagtacagcggcggacgggtgagtaacgcgtgggaatctgcccagtagtgggggacaacagccggaaacggctgctaataccgcatacgccctacgggggaaagcaggggatcttcggaccttgtgctattggatgagcccgcgtcagattagcttgttggtggggtaatggcctaccaaggcgacgatctgtagctggtctgagaggatgatcagccacatcgggactgagacacggcccgaactcctacgggaggcagcagtggggaatattggacaatgggggcaaccctgatccagccatgccgcgtgtgtgaagaaggccttcgggttgtaaagcactttcagcgaggaggaaagcctgatggctaatacccatcgggggtgacgttactcgcagaagaagcaccggctaactccgtgccagcagccgcggtaatacggagggtgcaagcgttaatcggaattactgggcgtaaagcgcacgtaggcggcgagttaagctagctgtgaaagccccgggctcaacctgggaactgcagttagaactggctagctagagtacggtagaggagtgtggaatttcctgtgtagcggtgaaatgcgtagatataggaaggaacatcagtggcgaaggcgacactctggactgatactgacgctgaggtgcgaaagcgtggggagcaaacaggattagataccctggtagtccacgccgtaaacgatgtctactagccgttgggagccttgagctcttagtggcgcagctaacgcactaagtagaccgcctggggagtacggccgcaaggttaaaactcaaatgaattgacgggggcccgcacaagcggtggagcatgtggtttaattcgacgcaacgcgaagaaccttaccaggccttgacatccttggaacttagcagagatgctttggtgccttcgggagccaagtgacaggtgctgcatggctgtcgtcagctcgtgtcgtgagatgttgggttaagtcccgtaacgagcgcaacccttgtccttagttgccagcacgtaatggtgggaactctaaggagactgccggtgacaaaccggaggaaggtggggacgacgtcaagtcatcatggcccttacggcctgggctacacacgtgctacaatgggcggtacaaagggttgccaatccgcgaggtggagctaatcccgaaaaaccgttcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaccagaagtggctagtctaacctcggaggacggtcaccacggtgtgattcatgactggggtgaagtcgtaacaaggtagccctaggggaacctggggctggatcacctccttaaac

SEQ ID NO: 5204 - DNA, 1554 bp, Marininema halotolerans
  ref <308>: DATABASE ACCESSION NUMBER: NCBI ACCESSION: NZ_FPAA01000024.1
  ref <309>: DATABASE ENTRY DATE: 2019-04-01
  ref <313>: RELEVANT RESIDUES IN SEQ ID NO: (1)..(1554)
ttttaacggagagtttgatcctggctcaggacgaacgctggcggcgtgcctaatacatgcaagtcgagcgaacggaggagagcttgctctccaaagttagcggcggacgggtgagtaacacgtgggcgacctgcccgtaagactgggataaccccgggaaaccggagctaataccagataggattttgggttgcatgacctgaaatggaaaggcggcttcggctgtcacttacggatgggcccgcggcgcattagctagttggtagggtaacggcctaccaaggcgacgatgcgtagccgacctgagagggtgaccggccacactgggactgagacacggcccagactcctacgggaggcagcagtagggaattttcgtcaatgggcgcaagcctgaacgagcaacgccgcgtgagtgaggacggctttcgggttgtaaagctctgttctctgggaagaacggcagaagggataataccccttttgtatgacggtaccagagaagaaagccccggctaactacgtgccagcagccgcggtaatacgtagggggcaagcgttgtccggaattattgggcgtaaagcgcgcgcaggcggcctgttaagtcggatgtgaaaggctacggctcaaccgtagaggtgcatccgaaactggcgggcttgagtgcaggagaggaaagtggaattcccggtgtagcggtggaatgcgtagatatcgggaggaacaccagtggcgaaggcggctttctggcctgtaactgacgctgaggcgcgaaagcgtggggagcaaacaggattagataccctggtagtccacgccgtaaacgatgagtgctaggtgttgggggtttcacgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccaaggcttgacatcccattgaaatctctagagatagaggccctcttcggagcaatggtgacaggtggtgcatggttgtcgtcagctcgtgtcgtgagatgttgggttcagtcccgcaacgagcgcaacccttatcgttagttgccagcatttagttgggcactctagcgagacagccggtgaaagccggaggaaggtggggatgacgtcaaatcatcatgccccttatgtcttgggctacacacgtgctacaatggttgggtacaacgggtagcgaagccgcgaggtggagccaatcccataaaaccaatctcagttcggatcgtaggctgcaactcgcctacgtgaagctggaatcgctagtaatcgcggatcagcatgccgcggtgaatacgttcccgggccttgtacacaccgcccgtcacaccacgagagtttgcaacacccgaagtcggtgagggaaccctttggggcccagccgccgaaggtggggcagatgattggggtgaagtcgtaacaaggtatccctaccggaaggtggggatggatcacctcctttcta

SEQ ID NO: 5205 - DNA, 1557 bp, Marininema mesophilum
  ref <308>: DATABASE ACCESSION NUMBER: NCBI ACCESSION: NZ_FNNQ01000032.1
  ref <309>: DATABASE ENTRY DATE: 2019-04-01
  ref <313>: RELEVANT RESIDUES IN SEQ ID NO: (1)..(1557)
ttttaacggagagtttgatcctggctcaggacgaacgctggcggcgtgcctaatacatgcaagtcgagcgaacggaggagagcttgctctccgaagttagcggcggacgggtgagtaacacgtgggcaacctgcccgtaagaccgggataacttcgggaaaccgaagctaataccggataggattttaggtcacatgacctaaaatggaaaggcggcttcggctgtcacttacggatgggcccgcggcgcattagctagttggtagggtaacggcttaccaaggcgacgatgcgtagccgacctgagagggtgaccggccacactgggactgagacacggcccagactcctacgggaggcagcagtagggaattttcgtcaatgggcgcaagcctgaacgagcaacgccgcgtgagtgaggacggctttcgggttgtaaagctctgttctctgggaagaacggcaggagggagaataccccttttgagtgacggtaccagagaagaaagccccggctaactacgtgccagcagccgcggtaatacgtagggggcaagcgttgtccggaattattgggcgtaaagcgcgcgcaggcggcctgttaagtcggatgtgaaaggctacggctcaaccgtagaggtgcatccgaaactggcgggcttgagtgcaggagaggaaagtggaattcccggtgtagcggtggaatgcgtagatatcgggaggaacaccagtggcgaaggcggctttctggcctgtaactgacgctgaggcgcgaaagcgtggggagcaaacaggattagataccctggtagtccacgccgtaaacgatgagtgctaggtgttgggggtttcacgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccaaggcttgacatcccattgcaacctctagagatagaggccctcttcggagcaatggtgacaggtggtgcatggttgtcgtcagctcgtgtcgtgagatgttgggttcagtcccgcaacgagcgcaacccttatcgttagttgccagcattgagttgggcactctagcgagacagccggtgaaagccggaggaaggtggggatgacgtcaaatcatcatgccccttatgtcttgggctacacacgtgctacaatggttggtacaacgggtagcgaagccgcgaggtgaagccaatcccaaaaaaccaatctcagttcggatcgtaggctgcaactcgcctgcgtgaagctggaatcgctagtaatcgcggatcagcatgccgcggtgaatacgttcccgggccttgtacacaccgcccgtcacaccacgagagtttgcaacacccgaagtcggtgagggaaccctttgggacccagccgccgaaggtggggcagatgattggggtgaagtcgtaacaaggtatccctaccggaaggtggggatggatcacctcctttctatgga

SEQ ID NO: 5206 - DNA, 1525 bp, Mariniphaga sediminis
  ref <308>: DATABASE ACCESSION NUMBER: NCBI ACCESSION: NZ_QWET01000043.1
  ref <309>: DATABASE ENTRY DATE: 2019-04-01
  ref <313>: RELEVANT RESIDUES IN SEQ ID NO: (1)..(1525)
tacaacggagagtttgatcctggctcaggatgaacgctagcgggaggcttaacacatgcaagccgagcggtaaggccccttcgggggtacacgagcggcgtacgggtgcgtaacgcgtatgcaacctgccttatgcagggggatagcccatggaaacgtggattaataccccataatattattttatcgcatggtaagatgattaaaattctggtggcataagatgggcatgcgtctgattagcttgttggtgaggtaacggctcaccaaggcaacgatcagtaggggtcctgagagggttaccccccacactggtactgagacacggaccagactcctacgggaggcagcagtgaggaatattggtcaatgggtgaaagcctgaaccagccatcccgcgtgcaggatgacggccctatgggttgtaaactgcttttctacgccaagaaacggccctacgtgtagggcactgacggtagcgtaggaataagcatcggctaactccgtgccagcagccgcggtaatacggaggatgcaagcgttatccggattcattgggtttaaagggtgcgcaggcgggcttgtaagtcagtggtgaaatactgccgcttaacggtagaattgccattgatactgcaggtcttgagtatggatgaggtaggcggaatgtgcagtgtagcggtgaaatgcatagatattgcacagaactccgattgcgaaggcagcttactaatccatgactgacgctgaggcacgaaagcgtggggagcgaacaggattagataccctggtagtccacgctgtaaacgatgttcactcgctgtttgcgatatacagtaagcggctgagcgaaagcattaagtgaaccacctggggagtacgatcgcaaggttgaaactcaaaggaattgacgggggcccgcacaagcggaggaacatgtggtttaattcgatgatacgcgaggaaccttacctgggcttaaatgtagagtgcatgcggtggaaacacccttcccttcggggctctctgcaaggtgctgcatggttgtcgtcagctcgtgccgtgaggtgtcgggttaagtcccataacgagcgcaacccctaccgttagttgccaacaggtcaagctggggactctagcgggactgccaccgtaaggtgagaggaaggtggggatgacgtcaaatcagcacggcccttatgtccagggctacacacgtgttacaatggccggtacagagggcagctaccccgcgaggggatgctaatctgaaaagccggtcccagttcggattggagtctgcaacccgactccatgaagttggattcgctagtaatcgcgcatcagccatggcgcggtgaatacgttcccgggccttgtacacaccgcccgtcaaaccatggaagctgggggtgcctgaagtctgtgaccgagaggagcggcctagggtaaaaccggtgactggggttaagtcgtaacaaggtagccgtaccggaaggtgtggctggaacacctcctttctgga

SEQ ID NO: 5207 - DNA, 1526 bp, Mariniradius saccharolyticus
  ref <308>: DATABASE ACCESSION NUMBER: NCBI ACCESSION: NZ_AMZY02000022.1
  ref <309>: DATABASE ENTRY DATE: 2019-04-01
  ref <313>: RELEVANT RESIDUES IN SEQ ID NO: (1)..(1526)
tactatggagagtttgatcctggctcaggatgaacgctagcggcaggcctaatacatgcaagtcgggcggcaagggaagtagcaatacgacccctagagcggcgtacgggtgcgcaacgcgtatgcaacctggcccctaccgggggatagcccgcggaaacgcggattaacaccccatggcgcgagtcggccgcatggctggcacgctaaaggttacggtaggggatgggcatgcgtgggattagctagttggcggggtaacggcccaccaaggcgacgatccctaggggttctgggaggaaggtcccccacactggcactgagatacgggccagactcctacgggaggcagcagtagggaatattgggcaatgggcggaagcctgacccagccatgccgcgtgcgggaagaaggccctttgggtcgtaaaccgcttttccgggggaagaaaaaggccgtgcgcggcagattgccggtaccccgggaataagcaccggctaactccgtgccagcagccgcggtaatacggagggtgcgagcgttgtccggatttattgggtctaaagggtgcgtaggcggcccgataagtcagcggtgaaagaccccggctcaaccggggggttgccgttgatactgtcgggcttgggtacggtctgggtacatggaattggtggtgtagcggtgaaatgcatagataccatcaggaacaccgatagcgtaggcattgtactgggccgtgaccgacgctgatgcacgaaagcgcgggtatcgaacaggattagataccctggtagtccgcgccgtaaacgatggacactcgctgttatcccgcaaaggggtagcggccaagcgaaggcgttaagtgtcccacctggggagtacgccggcaacggtgaaactcaaaggaattgacgggggtccgcacaagcggtggagcatgtggtttaattcgatgatacgcgaggaaccttacccgggctagaatgtgaggggatgtttcagaaatgaggcagtcggcaacgacccgaaacaaggtgctgcatggctgtcgtcagctcgtgccgtgaggtgttgggttaagtcccgcaacgagcgcaacccctgttgacagttgccagcacgtaaaggtggggactctgtcgagactgcccgcgcaagcggagaggaagggggggacgacgtcaagtcatcatggcccttacgcccggggcgacacacgtgctacaatggcgcatacagcgggtagctaggcggcgacgtccggccaacccctaaaagtgcgtctcagttcggatcggggcctgcaacccggccccgtgaagctggaatcgctagtaatcgcgcatcagccatggcgcggtgaatacgttcccggaccttgtacacaccgcccgtcaagccatgggagccgggtggacctgaaggcggtaaccgtcgaggagccgttcagggtaaaaccggtgactggggctaagtcgtaacaaggtagccgtaccggaaggtgcggctggaacacctcctttct

SEQ ID NO: 5208 - DNA, 1543 bp, Marinobacter flavimaris
  ref <308>: DATABASE ACCESSION NUMBER: NCBI ACCESSION: NZ_QRDH01000028.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcttaacacatgcaagtcgagcggtaacagatctagcttgctagatgctgacgagcggcggacgggtgagtaatgcataggaaactgcccagtagtgggggatagcccggggaaacccggattaataccgcgtacgcccttcgggggaaagcaggggatcttcggaccttgcgctattggatgtgcctatgtcggattagctagttggtggggtaaaggcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaaactctgcgactaatactcgtagggcttgacgttactcacagaagaagcaccggctaactccgtgccagcagccgcggtaatacggagggtgcaagcgttaatcggaattactgggcgtaaagcgcgcgtaggtggtttgataagcgagatgtgaaagccccgggcttaacctgggaacggcatttcgaactgtcaggctagagtatggtagagggtagtggaatttcctgtgtagcggtgaaatgcgtagatataggaaggaacaccagtggcgaaggcggctacctggaccaatactgacactgaggtgcgaaagcgtggggagcaaacaggattagataccctggtagtccacgccgtaaacgatgtctactagccgttgggactcttgaagtcttagtggcgcagctaacgcactaagtagaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggattggtgccttcgggaactctgacacaggtgctgcatggccgtcgtcagctcgtgtcgtgagatgttgggttaagtcccgtaacgagcgcaacccctatccctagttgctagcagttcggctgagaactctagggagactgccggtgacaaaccggaggaaggtggggatgacgtcaggtcatcatggcccttacggccagggctacacacgtgctacaatggtgcgcacagagggctgcaaacccgcgagggggagccaatctcacaaaacgcatcgtagtccggatcgcagtctgcaactcgactgcgtgaagtcggaatcgctagtaatcgtgaatcagaatgtcacggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaaac

SEQ ID NO: 5209 - DNA, 1544 bp, Marinobacter fuscus
  ref <308>: DATABASE ACCESSION NUMBER: NCBI ACCESSION: NZ_PXNP01000025.1
  ref <309>: DATABASE ENTRY DATE: 2019-04-01
  ref <313>: RELEVANT RESIDUES IN SEQ ID NO: (1)..(1544)
aaactgaagagtttgatcatggctcagattgaacgctggcggcaggcttaacacatgcaagtcgagcggtaacagggggtgcttgcactccgctgacgagcggcggacgggtgagtaatgcttaggaatctgcccagtagcgggggatagcccggggaaacccggattaataccgcatacgccctacgggggaaagcaggggatcttcggaccttgcgctattggatgagcctaagtcggattagctagttggtggggtaatggcctaccaaggcagcgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagcaaggaggaaggccttgaagttaataccttcaaggattgacgttacttgcagaagaagcaccggctaactccgtgccagcagccgcggtaatacggagggtgcaagcgttaatcggaattactgggcgtaaagcgcgcgtaggtggttcgataagcgagatgtgaaagccccgggctcaacctgggaacggcatttcgaactgtcgggctagagtatggtagagggtagtggaatttcctgtgtagcggtgaaatgcgtagatataggaaggaacaccagtggcgaaggcggctacctggaccaatactgacactgaggtgcgaaagcgtgggtagcaaacaggattagataccctggtagtccacgccgtaaacgatgtcaactagccgttgggactcttgaagtcttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatccagagaactttccagagatggattggtgccttcgggaactctgagacaggtgctgcatggccgtcgtcagctcgtgtcgtgagatgttgggttaagtcccgtaacgagcgcaacccctatccctggttgctagcaggtaatgctgagaactccagggagactgccggtgacaaaccggaggaaggtggggatgacgtcaggtcatcatggcccttacggccagggctacacacgtgctacaatggcgcgtacagagggctgccaactcgcgagagtgagccaatcccttaaagcgcgtcgtagtccggatcggagtctgcaactcgactccgtgaagtcggaatcgctagtaatcgcgaatcagaatgtcgcggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaaac

SEQ ID NO: 5210 - DNA, 1544 bp, Marinobacter hydrocarbonoclasticus
  ref <308>: DATABASE ACCESSION NUMBER: NCBI ACCESSION: NZ_RBJB01000010.1
  ref <309>: DATABASE ENTRY DATE: 2019-04-01
  ref <313>: RELEVANT RESIDUES IN SEQ ID NO: (1)..(1544)
aaactgaagagtttgatcatggctcagattgaacgctggcggcaggcttaacacatgcaagtcgagcggtaacaggggtagcttgctacccgctgacgagcggcggacgggtgagtaatgcttaggaatctgcccagtagtgggggatagcccggggaaacccggattaataccgcatacgtcctacgggagaaagcaggggatcttcggaccttgcgctattggatgagcctaagtcggattagctagttggtggggtaaaggcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtagggaggaaaaccttatggctaatacccatgaggcttgacgttacctacagaagaagcaccggctaactccgtgccagcagccgcggtaatacggagggtgcaagcgttaatcggaattactgggcgtaaagcgcgcgtaggtggtttggtaagcgagatgtgaaagccccgggcttaacctgggaacggcatttcgaactgtcagactagagtgtggtagagggtagtggaatttcctgtgtagcggtgaaatgcgtagatataggaaggaacaccagtggcgaaggcggctacctggaccaacactgacactgaggtgcgaaagcgtggggagcaaacaggattagataccctggtagtccacgccgtaaacgatgtcaactagccgttgggactcttgaagtcttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatccagagaactttccagagatggattggtgccttcgggaactctgagacaggtgctgcatggccgtcgtcagctcgtgtcgtgagatgttgggttaagtcccgtaacgagcgcaacccctatccctggttgctagcaggtaatgctgagaactccagggagactgccggtgacaaaccggaggaaggtggggatgacgtcaggtcatcatggcccttacggccagggctacacacgtgctacaatggcgcgtacagagggctgccaactcgcgagagtgagccaatcccttaaaacgcgtcgtagtccggatcggagtctgcaactcgactccgtgaagtcggaatcgctagtaatcgcgaatcagaatgtcgcggtgaatacgttcccgggccttgtacacaccgcccgtcacaccatgggagtggattgcaccagaagtagttagtctaaccttcgggaggacgattaccacggtgtggttcatgactggggtgaagtcgtaacaaggtagccgtaggggaacctgcggctggatcacctccttaaac

SEQ ID NO: 5211 - DNA, 1545 bp, Marinobacter litoralis
  ref <308>: DATABASE ACCESSION NUMBER: NCBI ACCESSION: NZ_QMDL01000008.1
  ref <309>: DATABASE ENTRY DATE: 2019-04-01
  ref <313>: RELEVANT RESIDUES IN SEQ ID NO: (1)..(1545)
taaactgaagagtttgatcatggctcagattgaacgctggcggcaggcttaacacatgcaagtcgagcggaaacgatgatagcttgctatcaggcgtcgagcggcggacgggtgagtaatgcttaggaatctgcccagtagtgggggacaacagtcggaaacggctgctaataccgcatacgccctacgggggaaagcaggggatcttcggaccttgcgctattggatgagcctaagtcggattagctagttggtgaggtaaaggctcaccaaggcgacgatccgtagctggtttgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagcgaggaggaaggctctaaagctaatacctttagggattgacgttactcgcagaagaagcaccggctaactccgtgccagcagccgcggtaatacggagggtgcaagcgttaatcggaattactgggcgtaaagcgcgcgtaggtggttgagtaagcgagatgtgaaagccccgggcttaacctgggaacggcatttcgaactgctcggctagagtgtggtagagggtagtggaatttcctgtgtagcggtgaaatgcgtagatataggaaggaacaccagtggcgaaggcggctacctggaccaacactgacactgaggtgcgaaagcgtggggagcaaacaggattagataccctggtagtccacgccgtaaacgatgtcaactagccgttggggatcttgaatccttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggattggtgccttcgggaactctgacacaggtgctgcatggccgtcgtcagctcgtgtcgtgagatgttgggttaagtcccgtaacgagcgcaacccctatccttggttgctagcaggtaatgctgagaactccagggagactgccggtgacaaaccggaggaaggtggggatgacgtcaggtcatcatggcccttacggccagggctacacacgtgctacaatggcgtatacagagggctgccaactcgcgagagtgagccaatcccttaaagtgcgtcgtagtccggatcgcagtctgcaactcgactgcgtgaagtcggaatcgctagtaatcgcgaatcagaatgtcgcggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccctaggggaacctggggctggatcacctccttaaac

SEQ ID NO: 5212 - DNA, 1451 bp, Marinobacter manganoxydans
  ref <308>: DATABASE ACCESSION NUMBER: NCBI ACCESSION: NZ_AGTR01000087.1
  ref <309>: DATABASE ENTRY DATE: 2019-04-01
  ref <313>: RELEVANT RESIDUES IN SEQ ID NO: (1)..(1451)
gctgacgagcggcggacgggtgagtaatgcataggaaactgcccagtagtgggggatagcccggggaaacccggattaataccgcgtacgcccttcgggggaaagcaggggatcttcggaccttgcgctattggatgtgcctatgtcggattagctagttggtggggtaaaggcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaaactctgcgactaatactcgtagggcttgacgttactcacagaagaagcaccggctaactccgtgccagcagccgcggtaatacggagggtgcaagcgttaatcggaattactgggcgtaaagcgcgcgtaggtggtttggtaagcgagatgtgaaagccccgggcttaacctgggaacggcatttcgaactgtcaggctagagtatggtagagggtagtggaatttcctgtgtagcggtgaaatgcgtagatataggaaggaacaccagtggcgaaggcggctacctggaccaatactgacactgaggtgcgaaagcgtggggagcaaacaggattagataccctggtagtccacgccgtaaacgatgtctactagccgttgggactcttgaagtcttagtggcgcagctaacgcactaagtagaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggattggtgccttcgggaactctgacacaggtgctgcatggccgtcgtcagctcgtgtcgtgagatgttgggttaagtcccgtaacgagcgcaacccctatccctagttgctagcagttcggctgagaactctagggagactgccggtgacaaaccggaggaaggtggggatgacgtcaggtcatcatggcccttacggccagggctacacacgtgctacaatggtgcgcacagagggctgcaaacccgcgagggggagccaatctcacaaaacgcatcgtagtccggatcgcagtctgcaactcgactgcgtgaagtcggaatcgctagtaatcgtgaatcagaatgtcacggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaaa

SEQ ID NO: 5213 - DNA, 1544 bp, Marinobacter nanhaiticus
  ref <308>: DATABASE ACCESSION NUMBER: NCBI ACCESSION: NZ_KB822693.1
  ref <309>: DATABASE ENTRY DATE: 2019-04-01
  ref <313>: RELEVANT RESIDUES IN SEQ ID NO: (1)..(1544)
aaactgaagagtttgatcatggctcagattgaacgctggcggcaggcttaacacatgcaagtcgagcggtaacagggggagcttgctccccgctgacgagcggcggacgggtgagtaatgcataggaaactgcccagtagtgggggatagcccggggaaacccggattaataccgcatacgtccttcgggagaaagcaggggctcttcggaccttgcgctattggatgtgcctatgtcggattagctagttggtggggtaagagcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaaagtgggtccctaatacgggctcgccttgacgttactcacagaagaagcaccggctaactccgtgccagcagccgcggtaatacggagggtgcaagcgttaatcggaattactgggcgtaaagcgcgcgtaggtggtttgataagcgagatgtgaaagccccgggcttaacctgggaacggcatttcgaactgtcaggctagagtatggtagagggtagtggaatttcctgtgtagcggtgaaatgcgtagatataggaaggaacaccagtggcgaaggcggctacctggaccaatactgacactgaggtgcgaaagcgtggggagcaaacaggattagataccctggtagtccacgccgtaaacgatgtcgactagccgttgggactcttgaagtcttagtggcgcagttaacgcactaagtcgaccgcctggggagtacggccgcaaggttaaaactcaaatgaattgacgggggcccgcacaagcggtggagcatgtggtttaattcgacgcaacgcgaagaaccttacctggccttgacatgttgggaaccttccagagatggaagggtgccttcgggaacccaaacacaggtgctgcatggccgtcgtcagctcgtgtcgtgagatgttgggttaagtcccgtaacgagcgcaacccctatccctagttgccagcacatgatggtgggaactctagggagactgccggtgacaaaccggaggaaggtggggatgacgtcaggtcatcatggcccttacggccagggctacacacgtgctacaatggcgcgcacagagggctgcgaacccgcgagggcaagctaatctcttaaaacgcgtcgtagtccggatcgcagtctgcaactcgactgcgtgaagtcggaatcgctagtaatcgcgaatcagaatgtcgcggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaaac

SEQ ID NO: 5214 - DNA, 1543 bp, Marinobacter salarius
  ref <308>: DATABASE ACCESSION NUMBER: NCBI ACCESSION: NZ_CP021333.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcttaacacatgcaagtcgagcggtaacagggggagcttgctccccgctgacgagcggcggacgggtgagtaatgcataggaaactgcccagtagtgggggatagcccggggaaacccggattaataccgcatacgccctttgggggaaagcaggggatcttcggaccttgcgctattggatgtgcctatgtcggattagctagttggtggggtaagagcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaaaccttacgactaatactcgtgaggcttgacgttactcacagaagaagcaccggctaactccgtgccagcagccgcggtaatacggagggtgcaagcgttaatcggaattactgggcgtaaagcgcgcgtaggtggtttgataagcgagatgtgaaagccccgggctcaacctgggaacggcatttcgaactgtcaggctagagtatggtagaggagtgtggaatttcctgtgtagcggtgaaatgcgtagatataggaaggaacaccagtggcgaaggcggcactctggaccaatactgacactgaggtgcgaaagcgtggggagcaaacaggattagataccctggtagtccacgctgtaaacgatgtcaactagccgttgggactcttgaagtcttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggattggtgccttcgggaactctgacacaggtgctgcatggccgtcgtcagctcgtgtcgtgagatgttgggttaagtcccgtaacgagcgcaacccctatccctagttgctagcagttcggctgagaactctagggagactgccggtgacaaaccggaggaaggtggggatgacgtcaggtcatcatggcccttacggccagggctacacacgtgctacaatggtgcgtacagagggctgcaaacccgcgagggggagctaatctcacaaaacgcatcgtagtccggatcggagtctgcaactcgactccgtgaagtcggaatcgctagtaatcgcgaatcagaatgtcgcggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaaac

SEQ ID NO: 5215 - DNA, 1547 bp, Marinobacter salinus
  ref <308>: DATABASE ACCESSION NUMBER: NCBI ACCESSION: NZ_CP017715.1
  ref <309>: DATABASE ENTRY DATE: 2019-04-01
  ref <313>: RELEVANT RESIDUES IN SEQ ID NO: (1)..(1547)
aaactgaagagtttgatcatggctcagattgaacgctggcggcaggcttaacacatgcaagtcgagcggtaacagggggtgcttgcaccccgctgacgagcggcggacgggtgagtaatgcttaggaatctgcccagtagtgggggatagcccggggaaacccggattaataccgcatacgccctacgggggaaagcaggggatcttcggaccttgcgctattggatgagcctaagtcggattagctagttggtggggtaagagcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaaagttagtcgttaatatcggctagccttgacgttactcacagaagaagcaccggctaactccgtgccagcagccgcggtaatacggagggtgcaagcgttaatcggaattactgggcgtaaagcgcgcgtaggtggtttgataagcgagatgtgaaagccccgggcttaacctgggaacggcatttcgaactgtcaggctagagtgtggtagagggtagtggaatttcctgtgtagcggtgaaatgcgtagatataggaaggaacaccagtggcgaaggcggctacctggaccaacactgacactgaggtgcgaaagcgtggggagcaaacaggattagataccctggtagtccacgccgtaaacgatgtcaactagccgttggggatcttgaatccttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggattggtgccttcgggaactctgacacaggtgctgcatggccgtcgtcagctcgtgtcgtgagatgttgggttaagtcccgtaacgagcgcaacccctatccctagttgctagcagttcggctgagaactctagggagactgccggtgacaaaccggaggaaggtggggatgacgtcaggtcatcatggcccttacggccagggctacacacgtgctacaatggcgcgcacagagggctgcaaacccgcgagggggagctaatctcacaaaacgcgtcgtagtccggatcggagtctgcaactcgactccgtgaagtcggaatcgctagtaatcgtgaatcagaatgtcacggtgaatacgttcccgggccttgtacacaccgcccgtcacaccatgggagtggattgcaccagaagtagttagtctaaccttcgggaggacgattaccacggtgtggttcatgactggggtgaagtcgtaacaaggtagccgtaggggaacctgcggctggatcacctccttaaacgaag

SEQ ID NO: 5216 - DNA, 1543 bp, Marinobacter sp. 3-2; identical to SEQ ID NO: 5208
  ref <308>: DATABASE ACCESSION NUMBER: NCBI ACCESSION: NZ_RJUQ01000006.1
  ref <309>: DATABASE ENTRY DATE: 2019-04-01
  ref <313>: RELEVANT RESIDUES IN SEQ ID NO: (1)..(1543)

SEQ ID NO: 5217 - DNA, 1241 bp, Marinobacter sp. ANT B65
  ref <308>: DATABASE ACCESSION NUMBER: NCBI ACCESSION: NZ_NXGV01000002.1
  ref <309>: DATABASE ENTRY DATE: 2019-04-01
  ref <313>: RELEVANT RESIDUES IN SEQ ID NO: (1)..(1241)
taaactgaagagtttgatcatggctcagattgaacgctggcggcaggcttaacacatgcaagtcgagcggaaacgatggtagcttgctaccaggcgtcgagcggcggacgggtgagtaatgcttaggaatctgcccagtagtgggggatagcccggggaaacccggattaataccgcatacgcccttttggggaaagcaggggatcttcggaccttgcgctattggatgagcctaagtcggattagctagttggtggggtaatggcccaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaggctttcagattaatactctggaggattgacgttactcacagaagaagcaccggctaactccgtgccagcagccgcggtaatacggagggtgcaagcgttaatcggaattactgggcgtaaagcgcgcgtaggtggttgagtaagcgagatgtgaaagccccgggcttaacctgggaacggcacttcgaactgctcggctagagtgtggtagagggtagtggaatttcctgtgtagcggtgaaatgcgtagatataggaaggaacaccagtggcgaaggcggctacctggaccaacactgacactgaggtgcgaaagcgtggggagcaaacaggattagataccctggtagtccacgccgtaaacgatgtcaactagccgttggggatcttgaatccttagtggcgcagctaacgcattaagttgaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggattggtgccttcgggaactctgacacaggtgctgcatggccgtcgtcagctcgtgtcgtgagatgttgggttaagtcccgtaacgagcgcaacccctatccctagttgctagcagttcggctgagaactctagggagactgccggtgacaaaccggaggaaggtggggatgacgtcaggtcatcatggcccttacggccagggctacacacgtgctacaatgg

SEQ ID NO: 5218 - DNA, 1540 bp, Marinobacter sp. Arc7-DN-1
  ref <308>: DATABASE ACCESSION NUMBER: NCBI ACCESSION: NZ_CP031848.1
  ref <309>: DATABASE ENTRY DATE: 2019-04-01
  ref <313>: RELEVANT RESIDUES IN SEQ ID NO: (1)..(1540)
taaactgaagagtttgatcatggctcagattgaacgctggcggcaggcttaacacatgcaagtcgagcggtaacaggtccttcgggatgctgacgagcggcggacgggtgagtaatgcttaggaatctgcctggtagtgggggatagcccggggaaacccggattaataccgcgtacgcccttcgggggaaagcaggggatcttcggaccttgcgctatcagatgagcctaagccggattagctagttggtggggtaaaggcccaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaggccttaaggttaatacccttgaggattgacgttactcacagaagaagcaccggctaactccgtgccagcagccgcggtaatacggagggtgcaagcgttaatcggaattactgggcgtaaagcgcgcgtaggtggtttgataagcgagatgtgaaagccccgggcttaacctgggaacggcatttcgaactgtcaggctagagtgtggtagaggggtgtggaatttcctgtgtagcggtgaaatgcgtagatataggaaggaacaccagtggcgaaggcggcaccctggaccaacactgacactgaggtgcgaaagcgtggggagcaaacaggattagataccctggtagtccacgccgtaaacgatgtcaactagccgttgggactcttgaagtcttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatgctgagaactttccagagatggattggtgccttcgggaactcagacacaggtgctgcatggccgtcgtcagctcgtgtcgtgagatgttgggttaagtcccgtaacgagcgcaacccctatccctagttgctagcagtttggctgagaactctagggagactgccggtgacaaaccggaggaaggtggggatgacgtcaggtcatcatggcccttacggccagggctacacacgtgctacaatggcgcgcacagagggctgcaaacccgcgagggggagccaatctcacaaaacgcgtcgtagtccggatcgcagtctgcaactcgactgcgtgaagtcggaatcgctagtaatcgtgaatcagaatgtcacggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaaac

SEQ ID NO: 5219 - DNA, 834 bp, Marinobacter sp. DSM 26671
  ref <308>: DATABASE ACCESSION NUMBER: NCBI ACCESSION: NZ_FONF01000027.1
  ref <309>: DATABASE ENTRY DATE: 2019-04-01
  ref <313>: RELEVANT RESIDUES IN SEQ ID NO: (1)..(834)
aaactgaagagtttgatcatggctcagattgaacgctggcggcaggcttaacacatgcaagtcgagcggaaacgatgggagcttgctcccaggcgtcgagcggcggacgggtgagtaatgcataggaatttgcccagtagtgggggatagcccggggaaacccggattaataccgcgtacgcccttcgggggaaagcaggggatcttcggaccttgcgctattggatgtgcctatgtcggattagctagttggtggggtaaaggcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaaaccctacgactaatactcgtaaggcttgacgttactcacagaagaagcaccggctaactccgtgccagcagccgcggtaatacggagggtgcaagcgttaatcggaattactgggcgtaaagcgcgcgtaggtggtttgataagcgagatgtgaaagccccgggcttaacctgggaacggcatttcgaactgtcaggctagagtatggtagagggtagtggaatttcctgtgtagcggtgaaatgcgtagatataggaaggaacaccagtggcgaaggcggctacctggaccaatactgacactgaggtgcgaaagcgtggggagcaaacaggattagataccctggtagtccacgccgtaaacgatgtctactagccgttgg

SEQ ID NO: 5220 - DNA, 1561 bp, Marinobacter sp. ELB17
  ref <308>: DATABASE ACCESSION NUMBER: NCBI ACCESSION: NZ_AAXY01000002.1
  ref <309>: DATABASE ENTRY DATE: 2019-04-01
  ref <313>: RELEVANT RESIDUES IN SEQ ID NO: (1)..(1561)
taaactgaagagtttgatcatggctcagattgaacgctggcggcaggcttaacacatgcaagtcgagcggaaacgatggtagcttgctaccaggcgtcgagcggcggacgggtgagtaatgcttaggaatctgcctagtagtgggggatagcccggggaaactcggattaataccgcatacgccctacgggggaaagcaggggattcgttctcttcggagagtggaccttgcgctattagatgagcctaagtcggattagcttgttggtggggtaatggcctaccaaggcaacgatccgtagctggtctgagaggatgatcagccacatcgggactgagacacggcccgaactcctacgggaggcagcagtggggaatattggacaatgggcgcaagcctgatccagccatgccgcgtgtgtgaagaaggctttcgggttgtaaagcactttcagcgaggaggaaggcctcaagattaatactcttgaggattgacgtcactcgcagaagaagcaccggctaactccgtgccagcagccgcggtaatacggagggtgcaagcgttaatcggaattactgggcgtaaagcgcgcgtaggtggttatgtaagcgagatgtgaaagccccgggctcaacctgggaacggcacttcgaactgcatggctagagtgtggtagagggtagtggaatttcctgtgtagcggtgaaatgcgtagatataggaaggaacaccagtggcgaaggcggctacctggaccaacactgacactgaggtgcgaaagcgtggggagcaaacaggattagataccctggtagtccacgccgtaaacgatgtcaactagccgttggggatcttgaatccttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggatcggtgccttcgggaactctgacacaggtgctgcatggccgtcgtcagctcgtgtcgtgagatgttgggttaagtcccgtaacgagcgcaacccctatccctagttgctagcaggtaatgctgagaactctagggagactgccggtgacaaaccggaggaaggtggggatgacgtcaggtcatcatggcccttacggccagggctacacacgtgctacaatggcgcgcacagagggctgcaaacccgcgagggggagccaatctcacaaaacgcgtcgtagtccggatcggagtctgcaactcgactccgtgaagtcggaatcgctagtaatcgtgaatcagaatgtcacggtgaatacgttcccgggccttgtacacaccgcccgtcacaccatgggagtggattgcaccagaagtagttagtctaaccttcgggaggacgattaccacggtgtggttcatgactggggtgaagtcgtaacaaggtagccctaggggaacctggggctggatcacctccttaaacga

SEQ ID NO: 5221 - DNA, 1542 bp, Marinobacter sp. F3R11
  ref <308>: DATABASE ACCESSION NUMBER: NCBI ACCESSION: NZ_QOCH01000014.1
  ref <309>: DATABASE ENTRY DATE: 2019-04-01
  ref <313>: RELEVANT RESIDUES IN SEQ ID NO: (1)..(1542)
taaactgaagagtttgatcatggctcagattgaacgctggcggcaggcttaacacatgcaagtcgagcggaaacgatggtagcttgctaccaggcgtcgagcggcggacgggtgagtaatgcttaggaatctgcccagtagtgggggatagcccggggaaacccggattaataccgcatacgcccttttggggaaagcaggggatcttcggaccttgcgctattggatgagcctaagtcggattagctagttggtggggtaaaggcccaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaggctttcagactaatactctggaagattgacgttactcacagaagaagcaccggctaactccgtgccagcagccgcggtaatacggagggtgcaagcgttaatcggaattactgggcgtaaagcgcgcgtaggtggttgagtaagcgagatgtgaaagccccgggcttaacctgggaacggcatttcgaactgctcggctagagtgtggtagagggtagtggaatttcctgtgtagcggtgaaatgcgtagatataggaaggaacaccagtggcgaaggcggctacctggatcaacactgacactgaggtgcgaaagcgtggggagcaaacaggattagataccctggtagtccacgccgtaaacgatgtcaactagccgttggggatcttgaatccttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggattggtgccttcgggaactctgacacaggtgctgcatggccgtcgtcagctcgtgtcgtgagatgttgggttaagtcccgtaacgagcgcaacccctatccctagttgctagcagttcggctgagaactctagggagactgccggtgacaaaccggaggaaggtggggatgacgtcaggtcatcatggcccttacggccagggctacacacgtgctacaatggtgcgtacagagggttgcaaacccgcgagggggagctaatctcacaaaacgcatcgtagtccggatcggagtctgcaactcgactccgtgaagtcggaatcgctagtaatcgtgaatcagaatgtcacggtgaatacgttcccgggccttgtacacaccgcccgtcacaccatgggagtggattgcaccagaagtagttagtctaaccttcgggaggacgattaccacggtgtggttcatgactggggtgaagtcgtaacaaggtagccctaggggaacctggggctggatcacctccttaa

SEQ ID NO: 5222 - DNA, 1557 bp, Marinobacter sp. LV10MA510-1
  ref <308>: DATABASE ACCESSION NUMBER: NCBI ACCESSION: NZ_PDJA01000001.1
  ref <309>: DATABASE ENTRY DATE: 2019-04-01
  ref <313>: RELEVANT RESIDUES IN SEQ ID NO: (1)..(1557)
taaactgaagagtttgatcatggctcagattgaacgctggcggcaggcttaacacatgcaagtcgagcggaaacgatggtagcttgctaccaggcgtcgagcggcggacgggtgagtaatgcttaggaatctgcctagtagtgggggatagcccggggaaactcggattaataccgcatacgccctacgggggaaagcaggggatccgctcttcggagaggaccttgcgctattagatgagcctaagtcggattagcttgttggtggggtaatggcctaccaaggcaacgatccgtagctggtctgagaggatgatcagccacatcgggactgagacacggcccgaactcctacgggaggcagcagtggggaatattggacaatgggcgcaagcctgatccagccatgccgcgtgtgtgaagaaggctttcgggttgtaaagcactttcagcgaggaggaaggccttaagcttaatacgcttgaggattgacgtcactcgcagaagaagcaccggctaactccgtgccagcagccgcggtaatacggagggtgcaagcgttaatcggaattactgggcgtaaagcgcgcgtaggtggttatgtaagcgagatgtgaaagccccgggctcaacctgggaacggcacttcgaactgcatggctagagtgtggtagagggtagtggaatttcctgtgtagcggtgaaatgcgtagatataggaaggaacaccagtggcgaaggcggctacctggaccaacactgacactgaggtgcgaaagcgtggggagcaaacaggattagataccctggtagtccacgccgtaaacgatgtcaactagccgttggggatcttgaatccttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatgcagagaacgttccagagatggatcggtgccttcgggaactctgacacaggtgctgcatggccgtcgtcagctcgtgtcgtgagatgttgggttaagtcccgtaacgagcgcaacccctatccctagttgctagcaggtaatgctgagaactctagggagactgccggtgacaaaccggaggaaggtggggatgacgtcaggtcatcatggcccttacggccagggctacacacgtgctacaatggcgcgcacagagggctgcaaacccgcgagggggagccaatctcacaaaacgcgtcgtagtccggatcggagtctgcaactcgactccgtgaagtcggaatcgctagtaatcgtgaatcagaatgtcacggtgaatacgttcccgggccttgtacacaccgcccgtcacaccatgggagtggattgcaccagaagtagttagtctaaccttcgggaggacgattaccacggtgtggttcatgactggggtgaagtcgtaacaaggtagccctaggggaacctggggctggatcacctccttaaacga

SEQ ID NO: 5223 - DNA, 1557 bp, Marinobacter sp. LV10R520-4
  ref <308>: DATABASE ACCESSION NUMBER: NCBI ACCESSION: NZ_PDJM01000001.1
  ref <309>: DATABASE ENTRY DATE: 2019-04-01
  ref <313>: RELEVANT RESIDUES IN SEQ ID NO: (1)..(1557)
taaactgaagagtttgatcatggctcagattgaacgctggcggcaggcttaacacatgcaagtcgagcggaaacgatggtagcttgctaccaggcgtcgagcggcggacgggtgagtaatgcttaggaatctgcctagtagtgggggatagcccggggaaactcggattaataccgcatacgccctacgggggaaagcaggggatccgctcttcggagaggaccttgcgctattagatgagcctaagtcggattagcttgttggtggggtaatggcctaccaaggcaacgatccgtagctggtctgagaggatgatcagccacatcgggactgagacacggcccgaactcctacgggaggcagcagtggggaatattggacaatgggcgcaagcctgatccagccatgccgcgtgtgtgaagaaggctttcgggttgtaaagcactttcagcgaggaggaaggccttaagactaatactcttgaggattgacgtcactcgcagaagaagcaccggctaactccgtgccagcagccgcggtaatacggagggtgcaagcgttaatcggaattactgggcgtaaagcgcgcgtaggtggttatgtaagcgagatgtgaaagccccgggctcaacctgggaacggcacttcgaactgcatggctagagtgtggtagagggtagtggaatttcctgtgtagcggtgaaatgcgtagatataggaaggaacaccagtggcgaaggcggctacctggaccaacactgacactgaggtgcgaaagcgtggggagcaaacaggattagataccctggtagtccacgccgtaaacgatgtcaactagccgttggggatcttgaatccttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggatcggtgccttcgggaactctgacacaggtgctgcatggccgtcgtcagctcgtgtcgtgagatgttgggttaagtcccgtaacgagcgcaacccctatccctagttgctagcaggtaatgctgagaactctagggagactgccggtgacaaaccggaggaaggtggggatgacgtcaggtcatcatggcccttacggccagggctacacacgtgctacaatggcgcgcacagagggctgcaaacccgcgagggggagccaatctcacaaaacgcgtcgtagtccggatcggagtctgcaactcgactccgtgaagtcggaatcgctagtaatcgtgaatcagaatgtcacggtgaatacgttcccgggccttgtacacaccgcccgtcacaccatgggagtggattgcaccagaagtagttagtctaaccttcgggaggacgattaccacggtgtggttcatgactggggtgaagtcgtaacaaggtagccctaggggaacctggggctggatcacctccttaaacga

SEQ ID NO: 5224 - DNA, 1543 bp, Marinobacter sp. NP-4 2019
  ref <308>: DATABASE ACCESSION NUMBER: NCBI ACCESSION: NZ_CP034142.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcttaacacatgcaagtcgagcggtaacagggggagcttgctccccgctgacgagcggcggacgggtgagtaatgcttaggaaactgcccagtagtgggggatagcccggggaaacccggattaataccgcgtacgcccttcgggggaaagcaggggctcttcggaccttgcgctattggatgtgcctaagtcggattagctagttggtggggtaaaggcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaggctgtaaggttaatacccttgcagattgacgttactcacagaagaagcaccggctaactccgtgccagcagccgcggtaatacggagggtgcaagcgttaatcggaattactgggcgtaaagcgcgcgtaggtggtttgataagcgagatgtgaaagccccgggcttaacctgggaacggcatttcgaactgtcaggctagagtgtggtagagggtagtggaatttcctgtgtagcggtgaaatgcgtagatataggaaggaacaccagtggcgaaggcggctacctggaccaacactgacactgaggtgcgaaagcgtggggagcaaacaggattagataccctggtagtccacgccgtaaacgatgtcaactagccgttgggactcttgaagtcttagtggcgcagctaacgcactaagttgaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggattggtgccttcgggaactctgacacaggtgctgcatggccgtcgtcagctcgtgtcgtgagatgttgggttaagtcccgtaacgagcgcaacccctatccctagttgctagcagttcggctgagaactctagggagactgccggtgacaaaccggaggaaggtggggatgacgtcaggtcatcatggcccttacggccagggctacacacgtgctacaatggcgcgcacagagggctgcaaacctgcgagggggagccaatctcacaaaacgcgtcgtagtccggatcggagtctgcaactcgactccgtgaagtcggaatcgctagtaatcgtgaatcagaatgtcacggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaaac

SEQ ID NO: 5225 - DNA, 1543 bp, Marinobacter sp. NP-6; identical to SEQ ID NO: 5214
  ref <308>: DATABASE ACCESSION NUMBER: NCBI ACCESSION: NZ_RPOA01000001.1
  ref <309>: DATABASE ENTRY DATE: 2019-04-01
  ref <313>: RELEVANT RESIDUES IN SEQ ID NO: (1)..(1543)

SEQ ID NO: 5226 - DNA, 1543 bp, Marinobacter sp. PT19DW; identical to SEQ ID NO: 5208
  ref <308>: DATABASE ACCESSION NUMBER: NCBI ACCESSION: NZ_PZZO01000016.1
  ref <309>: DATABASE ENTRY DATE: 2019-04-01
  ref <313>: RELEVANT RESIDUES IN SEQ ID NO: (1)..(1543)

SEQ ID NO: 5227 - DNA, 1545 bp, Marinobacter sp. R17
  ref <308>: DATABASE ACCESSION NUMBER: NCBI ACCESSION: NZ_RHGZ01000056.1
  ref <309>: DATABASE ENTRY DATE: 2019-04-01
  ref <313>: RELEVANT RESIDUES IN SEQ ID NO: (1)..(1545)
taaactgaagagtttgatcatggctcagattgaacgctggcggcaggcctaacacatgcaagtcgagcggtaacagatccagcttgctggatgctgacgagcggcggacgggtgagtaatgcataggaaactgcccagtagtgggggatagcccggggaaacccggattaataccgcatacgccctacgggggaaagcaggggctcttcggaccttgcgctattggatgtgcctatgtcggattagcttgttggtagggtaacggcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaggccttaaggttaatacccttgaggattgacgttactcacagaagaagcaccggctaactccgtgccagcagccgcggtaatacggagggtgcaagcgttaatcggaattactgggcgtaaagcgcgcgtaggtggttaggtaagcgagatgtgaaagccccgggcttaacctgggaacggcatttcgaactgtctggctagagtatggtagagggtagtggaatttcctgtgtagcggtgaaatgcgtagatataggaaggaacaccagtggcgaaggcggctacctggaccaatactgacactgaggtgcgaaagcgtggggagcaaacaggattagataccctggtagtccacgccgtaaacgatgtcgactagccgttgggactcttgaagtcttagtggcgcagttaacgcactaagtcgaccgcctggggagtacggccgcaaggttaaaactcaaatgaattgacgggggcccgcacaagcggtggagcatgtggtttaattcgacgcaacgcgaagaaccttacctggccttgacatgttgggaactttccagagatggattggtgccttcgggaacccaaacacaggtgctgcatggccgtcgtcagctcgtgtcgtgagatgttgggttaagtcccgtaacgagcgcaacccctatccctagttgccagcacatgatggtgggaactctagggagactgccggtgacaaaccggaggaaggtggggatgacgtcaggtcatcatggcccttacggccagggctacacacgtgctacaatggcgcgcacagagggctgcgaacccgcgagggcaagctaatctcttaaaacgcgtcgtagtccggatcgcagtctgcaactcgactgcgtgaagtcggaatcgctagtaatcgcgaatcagaatgtcgcggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaaac

SEQ ID NO: 5228 - DNA, 1543 bp, Marinobacter sp. es.042
  ref <308>: DATABASE ACCESSION NUMBER: NCBI ACCESSION: NZ_LT897781.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcttaacacatgcaagtcgagcggtaacagggggtgcttgcaccccgctgacgagcggcggacgggtgagtaatgcataggaaactgcccagtagtgggggatagcccggggaaacccggattaataccgcgtacgcccttcgggggaaagcaggggatcttcggaccttgcgctattggatgtgcctatgtcggattagctagttggtagggtaaaggcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagtgaggaggaaaattctgcgactaatactcgtagggcttgacgttactcacagaagaagcaccggctaactccgtgccagcagccgcggtaatacggagggtgcaagcgttaatcggaattactgggcgtaaagcgcgcgtaggtggtttgataagcgagatgtgaaagccccgggcttaacctgggaacggcatttcgaactgtcaggctagagtatggtagagggtagtggaatttcctgtgtagcggtgaaatgcgtagatataggaaggaacaccagtggcgaaggcggctacctggaccaatactgacactgaggtgcgaaagcgtggggagcaaacaggattagataccctggtagtccacgccgtaaacgatgtctactagccgttgggactcttgaagtcttagtggcgcagctaacgcactaagtagaccgcctggggagtacggccgcaaggttaaaactcaaatgaattgacgggggcccgcacaagcggtggagcatgtggtttaattcgacgcaacgcgaagaaccttacctggccttgacatgcagagaactttccagagatggattggtgccttcgggaactctgacacaggtgctgcatggccgtcgtcagctcgtgtcgtgagatgttgggttaagtcccgtaacgagcgcaacccctatccctagttgctagcagttcggctgagaactctagggagactgccggtgacaaaccggaggaaggtggggatgacgtcaggtcatcatggcccttacggccagggctacacacgtgctacaatggtgcgcacagagggctgcaaacccgcgagggggagccaatctcacaaaacgcatcgtagtccggatcgcagtctgcaactcgactgcgtgaagtcggaatcgctagtaatcgtgaatcagaatgtcacggtgaatacgttcccgggccttgtacacaccgcccgtcacaccatgggagtggattgcaccagaagtggttagtctaaccttcgggaggacgatcaccacggtgtggttcatgactggggtgaagtcgtaacaaggtagccgtaggggaacctgcggctggatcacctccttaaac

SEQ ID NO: 5229 - DNA, 1544 bp, Marinobacterium aestuarii
  ref <308>: DATABASE ACCESSION NUMBER: NCBI ACCESSION: NZ_CP015839.1
  ref <309>: DATABASE ENTRY DATE: 2019-04-01
  ref <313>: RELEVANT RESIDUES IN SEQ ID NO: (1)..(1544)
aaactgaagagtttgatcatggctcagattgaacgctggcggcaggcctaacacatgcaagtcgagcggtagagagaagcttgcttctcttgagagcggcggacgggtgagtaacgcgtaggaatctacctggtagtgggggacaacattcggaaacggatgctaataccgcatacgccctaagggggaaaggaggggatctatttatagacctttcgctatcagatgagcctgcgtaggattagctagttggtagggtaaaggcctaccaaggcgacgatccttagctggtctgagaggatgaccagccacactgggactgagacacggcccagactcctacgggaggcagcagtggggaatattggacaatgggggcaaccctgatccagccatgccgcgtgtgtgaagaaggccttcgggttgtaaagcactttcagtggtgaggaaagggtagcggctaataaccgttacctgtgacgttagccacagaagaagcaccggctaattccgtgccagcagccgcggtaatacggaaggtgcgagcgttaatcggaataactgggcgtaaagcgcgcgtaggtggttgagtcagtcagatgtgaaagccccgggcttaacctgggaactgcacctgatactgcttaactagagtacggtagagggcagtggaatttcctgtgtagcggtgaaatgcgtagatataggaaggaacaccagtggcgaaggcgactgcctggattgatactgacactgaggtgcgaaagcgtgggtagcaaacaggattagataccctggtagtccacgccgtaaacgatgtcgactagccgttgggagacttgctctcttagtggcgcagctaacgcaataagtcgaccgcctggggagtacggccgcaaggttaaaactcaaatgaattgacgggggcccgcacaagcggtggagcatgtggtttaattcgacgcaacgcgaagaaccttacctactcttgacatccagagaactcgctagagatagcttggtgccttcgggagctctgagacaggtgctgcatggctgtcgtcagctcgtgttgtgaaatgttgggttaagtcccgtaacgagcgcaacccttgtccttatttgccagcacgtaatggtgggaactctaaggagactgccggtgacaaaccggaggaaggtggggacgacgtcaagtcatcatggcccttacgagtagggctacacacgtgctacaatggccggtacagagggctgcaaacccgcgagggggagccaatctcacaaaaccggtcgtagtccggatcgcagtctgcaactcgactgcgtgaagtcggaatcgctagtaatcgtggatcagaatgccacggtgaatacgttcccgggccttgtacacaccgcccgtcacaccatgggagtgggttgcaccagaagtagctagtctaaccttcgggaggacggttaccacggtgtggtccatgactggggtgaagtcgtaacaaggtagccgtaggggaacctgcggctggatcacctccttaaac

SEQ ID NO: 5230 - DNA, 1552 bp, Marinobacterium lutimaris
  ref <308>: DATABASE ACCESSION NUMBER: NCBI ACCESSION: NZ_FNVQ01000016.1
  ref <309>: DATABASE ENTRY DATE: 2019-04-01
  ref <313>: RELEVANT RESIDUES IN SEQ ID NO: (1)..(1552)
aaactgaagagtttgatcatggctcagattgaacgctggcggcaggcctaacacatgcaagtcgagcggtaacaggggtagcttgctacccgctgacgagcggcggacgggtgagtaacgcgtaggaatctacctattagtgggggatagccaggggaaaccctgattaataccgcatacgctctacggaggaaagtgggggatcttttgacctcacgctaatagatgagcctgcgtaagattagctagttggtggggtaagagcccaccaaggcgacgatctttagctggtctgagaggatgatcagccacactgggactgagacacggcccagactcctacgggaggcagcagtggggaatattggacaatgggggcaaccctgatccagccatgccgcgtgtgtgaagaaggccttcgggttgtaaagcactttcagcagtgaggaaaggtgtgcggttaatacccgtatgctgtgacgttaactgcagaagaagcaccggctaactccgtgccagcagccgcggtaatacggagggtgcaagcgttaatcggaataactgggcgtaaagcgcgcgtaggtggtttggtcagtcagatgtgaaagcccagggctcaaccttggaattgcacctgatactgccaagctagagtacagtagaggggtgtggaatttccggtgtagcggtgaaatgcgtagagatcggaaggaacaccagtggcgaaggcgacaccctggactgatactgacactgaggtgcgaaagcgtggggagcaaacaggattagataccctggtagtccacgccgtaaacgatgtcaactagccgttggggaacttgattctttagtggcgaagctaacgcgataagttgaccgcctggggagtacggccgcaaggttaaaactcaaatgaattgacgggggcccgcacaagcggtggagcatgtggtttaattcgaagcaacgcgaagaaccttacctactcttgacatccagagaactttccagagatggattggtgccttcgggaactctgagacaggtgctgcatggctgtcgtcagctcgtgttgtgaaatgttgggttaagtcccgtaacgagcgcaacccttatccttatttgccagcacttcgggtgggaactctaaggagactgccggtgacaaaccggaggaaggtggggatgacgtcaagtcatcatggcccttacgagtagggctacacacgtgctacaatggctggtacagagggtcgcgaacctgcgaaggtaagctaatctcagaaaaccggtcgtagtccggattggagtctgcaactcgactccatgaagtcggaatcgctagtaatcgcggatcagaatgccgcggtgaatacgttcccgggccttgtacacaccgcccgtcacaccatgggagtggattccaccagaagtaggtagcttaaccttcgggagagcgcttaccacggtgaggttcacgactggggtgaagtcgtaacaaggtagccgttggggaaccagcggctggatcacctccttaaacgatagctta

SEQ ID NO: 5231 - DNA, 1576 bp, Marinococcus halophilus
  ref <308>: DATABASE ACCESSION NUMBER: NCBI ACCESSION: NZ_FVZD01000006.1
  ref <309>: DATABASE ENTRY DATE: 2019-04-01
  ref <313>: RELEVANT RESIDUES IN SEQ ID NO: (1)..(1576)
tttacggagagtttgatcctggctcaggacgaacgctggcggcgtgcctaatacatgcaagtcgagcgcgggaagccggcggactccttcgggaggaaaccggtggaacgagcggcggacgggtgagtaacacgtgggcaacctgccggactgatgggaataaccccgggaaaccggggctaatgcccaatacgccctgacctcgcctgaggtcagcggcaaagcagggatcttcggatccttgcgcagtccgatgggcccgcggcgcattagctagttggagaggtaagggctccccaaggcgacgatgcgtagccgacctgagagggtgatcggccacactgggactgagacacggcccagactcctacgggaggcagcagtagggaatcatccgcaatgggcgaaagcctgacggtgcaacgccgcgtgagtgatgaaggttttcggatcgtaaagctctgttgacagggaagaacccacgccagtcgaacaggctggcgtgctgacggtacctgtccagaaagccccggctaactacgtgccagcagccgcggtaatacgtagggggcaagcgttgtccggaattattgggcgtaaagggcacgcaggcggtttcgtcagtccgatgtgacaggccacggctcaaccgtggaaggccattggaaactgcgaaacttgaggacagaagaggagagtggaattccacgtgtagcggtgaaatgcgtagatatgtggaggaacaccagtggcgaaggcgactctctggtctgtacctgacgctgaggtgcgaaagcatggggagcaaacaggattagataccctggtagtccatgccgtaaacgctgagtgctaggtgttaggggtttcgatacccgtagtgccgaagctaacgcattaagcactccgcctggggagtacgaccgcaaggttgaaactcaaaggaattgacgggggcccgcacaagcggtggagcatgtggtttaattcgacgcaacgcgaagaaccttaccagatcttgacatcttccgctacgcctcgagagaggcggttccccttcgggggacggaatgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggtggggatgacgtcaaatcatcatgccccttatgatctgggctacacacgtgctacaatggatggtacaacgggaagcgaacccgcgagggggagccaatccagaaaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgagggaaccctgctgggacccagccgccgaaggtggggcagatgattggggtgaagtcgtaacaaggtatccctaccggaaggtggggatggatcacctcctttcta

SEQ ID NO: 5232 - DNA, 307 bp, Marinococcus halotolerans
  ref <308>: DATABASE ACCESSION NUMBER: NCBI ACCESSION: NZ_ATVM01000004.1
  ref <309>: DATABASE ENTRY DATE: 2019-04-01
  ref <313>: RELEVANT RESIDUES IN SEQ ID NO: (1)..(307)
ttttacggagagtttgatcctggctcaggacgaacgctggcggcgtgcctaatacatgcaagtcgagcgcgggaagccggcggactccttcgggaggaaaccggtggaacgagcggcggacgggtgagtaacacgtgggcaacctgccggactgatgggaataaccccgggaaaccggggctaatgcccaatacgccctgacctcgcctgaggtcagcggtaaagcagggatcttcggatccttgcacagtccgatgggcccgcggcgcattagctagttggagaggtaagggctccccaaggcgac

SEQ ID NO: 5233 - DNA, 1576 bp, Marinococcus luteus
  ref <308>: DATABASE ACCESSION NUMBER: NCBI ACCESSION: NZ_FNNC01000012.1
  ref <309>: DATABASE ENTRY DATE: 2019-04-01
  ref <313>: RELEVANT RESIDUES IN SEQ ID NO: (1)..(1576)
tttacggagagtttgatcctggctcaggacgaacgctggcggcgtgcctaatacatgcaagtcgagcgcgggaagccggcggactccttcgggaggaaaccggtggaacgagcggcggacgggtgagtaacacgtgggcaacctgccggactgatgggaataaccccgggaaaccggggctaatgcccaatacgccctgacctcgcctgaggtcagcggtaaagcagggatcttcggatccttgcacagtccgatgggcccgcggcgcattagctagttggagaggtaagggctccccaaggcgacgatgcgtagccgacctgagagggtgatcggccacactgggactgagacacggcccagactcctacgggaggcagcagtagggaatcatccgcaatgggcgaaagcctgacggtgcaacgccgcgtgagtgatgaaggttttcggatcgtaaagctctgttgacagggaagaacccacgccagtcgaacaggctggcgtgctgacggtacctgtccagaaagccccggctaactacgtgccagcagccgcggtaatacgtagggggcaagcgttgtccggaattattgggcgtaaagggcacgcaggcggtttcgtcagtccgatgtgacaggccacggctcaaccgtggaaggccattggaaactgcgaaacttgaggacagaagaggagagtggaattccacgtgtagcggtgaaatgcgtagatatgtggaggaacaccagtggcgaaggcgactctctggtctgtacctgacgctgaggtgcgaaagcatggggagcaaacaggattagataccctggtagtccatgccgtaaacgctgagtgctaggtgttaggggtttcgatacccgtagtgccgaagctaacgcattaagcactccgcctggggagtacgaccgcaaggttgaaactcaaaggaattgacgggggcccgcacaagcggtggagcatgtggtttaattcgacgcaacgcgaagaaccttaccagatcttgacatcttccgctacgcctcgagagaggcggttccccttcgggggacggaatgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggtggggatgacgtcaaatcatcatgccccttatgatctgggctacacacgtgctacaatggatggtacaacgggacgcgaacccgcgagggggagccaatccagaaaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtgagggaacccttctgggacccagccgccgaaggtggggcagatgattggggtgaagtcgtaacaaggtatccctaccggaaggtggggatggatcacctcctttcta

SEQ ID NO: 5234 - DNA, 1545 bp, Marinomonas hwangdonensis
  ref <308>: DATABASE ACCESSION NUMBER: NCBI ACCESSION: NZ_RIZG01000020.1
  ref <309>: DATABASE ENTRY DATE: 2019-04-01
  ref <313>: RELEVANT RESIDUES IN SEQ ID NO: (1)..(1545)
taactgaagagtttgatcatggctcagattgaacgctggcggcaggcttaacacatgcaagtcgagcggtagcacagagaaacttgtttcttgggtgacgagcggcggacgggtgagtaacgcgtaggaatctacctagtagagggggacaacatgtggaaacgcatgctaataccgcatacgcccttagggggaaaggaggggacttttcggagccttccgctattagatgagcctgcgtgagattagctagttggtagggtaaaggcctaccaaggcgacgatctctaactggtctgagaggatgaccagtcacactgggactgagacacggcccagactcctacgggaggcagcagtggggaatattggacaatgggcgcaagcctgatccagccatgccgcgtgtgtgaagaaggccttagggttgtaaagcactttcaggggtgaggaagggcgtttggttaatacctaaacgtcttgacgttagccccagaagaagcaccggctaactctgtgccagcagccgcggtaatacagagggtgcaagcgttaatcggaattactgggcgtaaagcgcgcgtaggtggtttgttaagtcggatgtgaaatcccagggctcaaccttggaatggcacccgatactggcaagctagagtatggtagaggggtgtggaatttcctgtgtagcggtgaaatgcgtagatataggaaggaacatcagtggcgaaggcgacaccctggactaatactgacactgaggtgcgaaagcgtggggagcaaacaggattagataccctggtagtccacgccgtaaacgatgtctactagccgttgggttgtaatgacttagtggcgcagctaacgcaataagtagaccgcctggggagtacggccgcaaggttaaaactcaaatgaattgacgggggcccgcacaagcggtggagcatgtggtttaattcgacgcaacgcgaagaaccttacctactcttgacatccagagaattcgctagagatagcttagtgccttcgggaactctgagacaggtgctgcatggctgtcgtcagctcgtgttgtgaaatgttgggttaagtcccgtaacgagcgcaacccttatccttatttgccagcacttcgggtgggaactttaaggagactgccggtgacaaaccggaggaaggtggggacgacgtcaagtcatcatggcccttacgagtagggctacacacgtgctacaatggcgtatacagagggctgcgagctagcgatagtgagcgaatcccagaaagtacgtcgtagtccggattggagtctgcaactcgactccatgaagtcggaatcgctagtaatcgtgaatcagaatgtcacggtgaatacgttcccgggccttgtacacaccgcccgtcacaccatgggagttgattgctccagaagtagctagcctaaccgcaaggggggcggttaccacggagtggtcaatgactggggtgaagtcgtaacaaggtagccctaggggaacctggggctggatcacctccttaaac

SEQ ID NO: 5235 - DNA, 1544 bp, Marinomonas pollencensis
  ref <308>: DATABASE ACCESSION NUMBER: NCBI ACCESSION: NZ_QUNG01000028.1
  ref <309>: DATABASE ENTRY DATE: 2019-04-01
  ref <313>: RELEVANT RESIDUES IN SEQ ID NO: (1)..(1544)
taactgaagagtttgatcatggctcagattgaacgctggcggcaggcttaacacatgcaagtcgagcggaaacgatgatagcttgctatcaggcgtcgagcggcggacgggtgagtaacgcgtaggaatctgcctagtagtgggggacaacatgtggaaacgcatgctaataccgcatacgccctacgggggaaaggaggggatcttcggacctttcgctattagatgagcctgcgtaagattagctagttggtggggtaaaggcctaccaaggcgacgatctttagctggtctgagaggatgaccagtcacactgggactgagacacggcccagactcctacgggaggcagcagtggggaatattggacaatgggcgcaagcctgatccagccatgccgcgtgtgtgaagaaggccttagggttgtaaagcactttcaggggtgaggaagggtaagtcgttaataccggcttactttgacgttaaccccagaagaagcaccggctaactctgtgccagcagccgcggtaatacagagggtgcaagcgttaatcggaattactgggcgtaaagcgcgcgtaggtggtttgttaagtcggatgtgaaatcccagggctcaaccttggaatggcacccgatactggcaggctagagtacggtagaggggtgtggaatttcctgtgtagcggtgaaatgcgtagatataggaaggaacatcagtggcgaaggcgacaccctggactgatactgacactgaggtgcgaaagcgtggggagcaaacaggattagataccctggtagtccacgccgtaaacgatgtctactagccgttgggttgtaatgacttagtggcgcagctaacgcaataagtagaccgcctggggagtacggccgcaaggttaaaactcaaatgaattgacgggggcccgcacaagcggtggagcatgtggtttaattcgaagcaacgcgaagaaccttacctactcttgacatccagtgaacttagcagagatgctttggtgccttcgggaacactgagacaggtgctgcatggctgtcgtcagctcgtgttgtgaaatgttgggttaagtcccgtaacgagcgcaacccttatccttacttgctagcaggttatgctgagaactttaaggagactgccggtgacaaaccggaggaaggtggggacgacgtcaagtcatcatggcccttacgagtagggctacacacgtgctacaatggcgtatacagagggctgcgaacttgcgagagtaagcgaatcccagaaagtacgtcgtagtccggattggagtctgcaactcgactccatgaagtcggaatcgctagtaatcgtgaatcagaatgtcacggtgaatacgttcccgggccttgtacacaccgcccgtcacaccatgggagttgattgctccagaagtagctagcttaacctttcgaggatggcggttaccacggagtggtcaatgactggggtgaagtcgtaacaaggtagccctaggggaacctggggctggatcacctccttaaac

SEQ ID NO: 5236 - DNA, 1543 bp, Marinomonas rhizomae
  ref <308>: DATABASE ACCESSION NUMBER: NCBI ACCESSION: NZ_RIZH01000039.1
  ref <309>: DATABASE ENTRY DATE: 2019-04-01
  ref <313>: RELEVANT RESIDUES IN SEQ ID NO: (1)..(1543)
taactgaagagtttgatcatggctcagattgaacgctggcggcaggcttaacacatgcaagtcgagcggtaacaggggagcttgctcctgctgacgagcggcggacgggtgagtaacgcgtaggaatctgcctagtagagggggacaacatgtggaaacgcatgctaataccgcatacgccctacgggggaaaggaggggacttttcggagccttccgctattagatgagcctgcgtaagattagctagttggtagggtaaaggcctaccaaggcgacgatctttaactggtctgagaggatgaccagtcacactgggactgagacacggcccagactcctacgggaggcagcagtggggaatattggacaatgggcgcaagcctgatccagccatgccgcgtgtgtgaagaaggccttagggttgtaaagcactttcaggagtgaggaagggtaattagttaatacctaattattttgacgttagctccagaagaagcaccggctaactctgtgccagcagccgcggtaatacagagggtgcaagcgttaatcggaattactgggcgtaaagcgcgcgtaggtggtttgttaagtcggatgtgaaatcccagggctcaaccttggaatggcacccgatactggcaggctagagtatggtagaggggtgtggaatttcctgtgtagcggtgaaatgcgtagatataggaaggaacatcagtggcgaaggcgacaccctggactaatactgacactgaggtgcgaaagcgtggggagcaaacaggattagataccctggtagtccacgccgtaaacgatgtctactagccgttgggttgtaatgacttagtggcgcagctaacgcaataagtagaccgcctggggagtacggccgcaaggttaaaactcaaatgaattgacgggggcccgcacaagcggtggagcatgtggtttaattcgacgcaacgcgaagaaccttacctactcttgacatccagagaattcgctagagatagcttagtgccttcgggaactctgagacaggtgctgcatggctgtcgtcagctcgtgttgtgaaatgttgggttaagtcccgtaacgagcgcaacccttatccttatttgccagcacttcgggtgggaactttaaggagactgccggtgacaaaccggaggaaggtggggacgacgtcaagtcatcatggcccttacgagtagggctacacacgtgctacaatggcgtatacagagggctgcgaacttgcgagagtaagcgaatcccagaaagtacgtcgtagtccggattggagtctgcaactcgactccatgaagtcggaatcgctagtaatcgtgaatcagaatgtcacggtgaatacgttcccgggccttgtacacaccgcccgtcacaccatgggagttgattgctccagaagtagctagcttaacccttcggggatggcggttaccacggagtggtcaatgactggggtgaagtcgtaacaaggtagccctaggggaacctggggctggatcacctccttaaac

SEQ ID NO: 5237 - DNA, 1545 bp, Marinomonas sp. MED121
  ref <308>: DATABASE ACCESSION NUMBER: NCBI ACCESSION: NZ_CH672433.1
  ref <309>: DATABASE ENTRY DATE: 2019-04-01
  ref <313>: RELEVANT RESIDUES IN SEQ ID NO: (1)..(1545)
taaactgaagagtttgatcatggctcagattgaacgctggcggtaggcttaacacatgcaagtcgagcggaaacgatgtagcttgctacaggcgtcgagcggcggacgggtgagtaacgcgtaggaatctgcctagtagtgggggacaacctgtggaaacgcaggctaataccgcaaaagcccctgagggggaaaggaggggatcttcggacctttcgctattataatgagcctgcgtgagattagctagttggtgaggtaaaggctcaccaaggcgacgatctctagctggtctgagaggatgatcagccacactgggactgagacacggcccagactcctacgggaggcagcagtggggaatattggacaatgggcgcaagcctgatccagccataccgcgtgtgtgaagaaggccctagggttgtaaagcactttcagaagggaggaaagggtgttgcttaatacgtaatatctgtgacgttaccttcagaagaagcaccggctaactctgtgccagcagccgcggtaatacagagggtgcaagcgttaatcggaattactgggcgtaaagcgcgcgtaggtggtttgttaagtcggatgtgaaagcccagggctcaaccttggaattgcacccgatactggcaggctagagtacgatagaggagtgtggaatttcctgtgtagcggtgaaatgcgtagatataggaaggaacatcagtggcgaaggcgacactctggattgatactgacactgaggtgcgaaagcgtggggagcaaacaggattagataccctggtagtccacgccgtaaacgatgtctactagccgttgggttgtaatgacttagtggcgaagctaacgcgataagtagaccgcctggggagtacggccgcaaggttaaaactcaaatgaattgacgggggcccgcacaagcggtggagcatgtggtttaattcgaagcaacgcgaagaaccttacctactcttgacatccatagaatttagcagagatgcttaagtgccttcgggaactatgagacaggtgctgcatggctgtcgtcagctcgtgttgtgaaatgttgggttaagtcccgtaacgagcgcaacccttgtccttatttgccagcgagtaatgtcgggaactttaaggagactgccggtgacaaaccggaggaaggtggggacgacgtcaagtcatcatggcccttacgagtagggctacacacgtgctacaatggcgcatacagagggctgcgaacttgcgagagtaagcgaatcccataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagttgattgctccagaagtagctagcttaacccttcggggagggcggttaccacggagtggtcaatgactggggtgaagtcgtaacaaggtagccctaggggaacctggggctggatcacctccttaaac

SEQ ID NO: 5238 - DNA, 1524 bp, Marinoscillum furvescens
  ref <308>: DATABASE ACCESSION NUMBER: NCBI ACCESSION: NZ_QREG01000042.1
  ref <309>: DATABASE ENTRY DATE: 2019-04-01
  ref <313>: RELEVANT RESIDUES IN SEQ ID NO: (1)..(1524)
tatacaatggagagtttgatcctggctcaggatgaacgctagcggcaggcctaatacatgcaagtcgaggggcagcatagtcttcggactgatggcgaccggcgaacgggtgcgtaacgcgtatgcaacttacctattactgagggatagcccggggaaacccggattaatacctcatggtatcacttgatggcatctgaaggtgattaaagatttatcggtaatagatgggcatgcgtctgattagttagatggtgaggtaacggctcaccatggcaatgatcagtaggggttctgagaggatgatcccccacactggcactgagatacgggccagactcctacgggaggcagcagtagggaatattggtcaatgggcgagagcctgaaccagccatgccgcgtgcaggatgacggccttctgggttgtaaactgcttttctacaggaagaaaaagcccttgcgagggaaattgccggtattgtaggaataagcaccggctaactccgtgccagcagccgcggtaatacggagggtgcaagcgttgtccggatttattgggtttaaagggtgcgtaggcgggattttaagtcagtggtgaaagcccacagctcaactgtggaactgccattgatactggaatccttgaattcagttgaggtaggcggaattgatggtgtagcggtgaaatgcatagataccatcaggaacaccgattgcgaaggcagcttactgggcttgaattgacgctgaggcacgaaagcgtggggagcgaacaggattagataccctggtagtccacgccgtaaacgatgataactcgctgttggcgatacacagtcagcggccaagcgaaagcgttaagttatccacctggggagtacgctcgcaagagtgaaactcaaaggaattgacgggggtccgcacaagcggtggagcatgtggtttaattcgatgatacgcgaggaaccttacctggactagaatgcgagtgctatctgcagagatgcggagttcttcggacacgaagcaaggtgctgcatggctgtcgtcagctcgtgccgtgaggtgttgggttaagtcccgcaacgagcgcaacccctattcttagttgccagcatgtaatgatggggactctaaggagactgcctgcgcaagcagagaggaaggaggggatgacgtcaagtcatcatggcccttacgtccagggctacacacgtgctacaatggagggtacagagggtcgctacacagcaatgtgatgccaatctcaaaaagcccttctcagttcggatcggggtctgcaactcgaccccgtgaagctggaatcgctagtaatcgcgcatcagcaatggcgcggtgaatacgttcccggaccttgtacacaccgcccgtcaagccatgggagttgggtatgcctgaagatggttgccgagaggcgctgtttagggcagaatcagcgactggggctaagtcgtaacaaggtagccgtaccggaaggtgcggctggaacacctcctttct

SEQ ID NO: 5239 - DNA, 1469 bp, Marinovum algicola
  ref <308>: DATABASE ACCESSION NUMBER: NCBI ACCESSION: NZ_FWFM01000038.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgagctcttcggagctagcggcggacgggttagtaacgcgtgggaacgtgcccttcactgcggaatagccactggaaacggtgagtaataccgcatacgcccttcgggggaaagatttatcggtgaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagttgggggtgaaatcccggggctcaaccccggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcagctacatcgagagatcgatggttcccttcggggactgagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcgacggcatgaagtcggaatcgctagtaatcgcgtaacagcatgacgcggtgaatacgttcccgggccttgtacacaccgcccgtcacaccatgggagttgggttcacccgaaggccgtgcgccaacctttcgaggaggcagcggaccacggtgagctcagcgactggggtgaagtcgtaacaaggtagccgtaggggaacctgcggctggatcacctcctttctaa

SEQ ID NO: 5240 - DNA, 1489 bp, Maritalea myrionectae
  ref <308>: DATABASE ACCESSION NUMBER: NCBI ACCESSION: NZ_CP021330.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgctcacttcggtgggagcggcagacgggtgagtaacgcgtgggaacatacctagtagtacggaataacgtttggaaacgaacgctaataccgtatacgccctcagggggaaagatttatcgctattagattggcccgcgttggattagtttgttggtggggtaatggcctaccaagactacgatctatagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcgctagggaagataatgacggtacctagtaaagaagccccggctaacttcgtgccagcagccgcggtaatacgaagggggctagcgttgttcggaattactgggcgtaaagcgcacgtaggcggattagtaagttaggggtgaaatcccgaggctcaacctcggaactgcctttaatactgctagtctcgagttcgggagaggtgtatggaactcctagtgtagaggtggaattcgtagatattaggaagaacaccagtggcgaaggcgatacactggcccgatactgacgctgaggtgcgaaagcgtggggagcaaacaggattagataccctggtagtccacgccgtaaacgatgagagctagccgttggggtgtttacacttcagtggcgcagttaacgcattaagctctccgcctggggagtacggtcgcaagattaaaactcaaaggaattgacgggggcccgcacaagcggtggagcatgtggtttaattcgaagcaacgcgaagaaccttaccagctcttgacatacctatcgcagtctccggagacggagaccttcagttcggctggataggatacaggtgctgcacggctgtcgtcagctcgtgtcgtgagatgttgggttaagtcccgcaacgagcgcaaccctcgcccttagttgccagcatttagttgggcactctagggggactgccggtgataagccggaggaaggtggggacgacgtcaagtcatcatggcccttacgggctgggctacacacgtgctacaatggcggtgacagagggcagccactccgcgaggaggagctaatccctaaaaaccgtctcagttcggattgcactctgcaactcgagtgcatgaagttggaatcgctagtaatcgtgggtcagcataccacggtgaatacgttcccgggccttgtacacaccgcccgtcacaccatgggagttggttctacccgaaggcgctgcgctaacttttgaggcaggcgaccacggtagggtcagcgactggggtgaagtcgtaacaaggtagccgtaggggaacctgcggctggatcacctcctttctaagg

SEQ ID NO: 5241 - DNA, 1472 bp, Maritimibacter alkaliphilus
  ref <308>: DATABASE ACCESSION NUMBER: NCBI ACCESSION: NZ_CH902578.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgagcgaagccttcgggcttagcggcggacgggttagtaacgcgtgggaacgtgcccttcactacggaatagtcccgggaaactgggtttaataccgtatacgcccttcgggggaaagatttatcggtgaaggatcggcccgcgtctgattagatagttggtggggtaacggcctaccaagtctacgatcagtagctggtttgagaggatgatcagcaacactgggactgagacacggcccagactcctacgggaggcagcagtggggaatcttagacaatgggcgcaagcctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattagtcagtcagaggtgaaatcccggggctcaaccccggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagtatacttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttttccgagaggaattccttcagttcggctggatcagtgacaggtgctgcatggctgtcgtcagctcgtgtcgtgagatgttcggttaagtccggcaacgagcgcaacccacgcctttagttgccagcagttcggctgggcactctaaaggaactgcccgtgataagcgggaggaaggtgtggatgacgtcaagtcctcatggcccttacgggttgggctacacacgtgctacaatggtggtgacaatgggttaatccctaaaaaccatctcagttcggattgtcgtctgcaactcgacggcatgaagtcggaatcgctagtaatcgcgtaacagcatgacgcggtgaatacgttcccgggccttgtacacaccgcccgtcacaccatgggagttgggtctacccgacggccgtgcgctaacctttcgaggaggcagcggaccacggtaggctcagcgactggggtgaagtcgtaacaaggtagccgtaggggaacctgcggctggatcacctcctttctaa

SEQ ID NO: 5242 - DNA, 1470 bp, Maritimibacter sp. 55A14
  ref <308>: DATABASE ACCESSION NUMBER: NCBI ACCESSION: NZ_QEYE01000024.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcacgcctaacacatgcaagtcgaacgaagccttcgggcttagtggcggacgggttagtaacgcgtgggaacgtacccttcactacggaatagtcccgggaaactgggtttaataccgtatacgcccttcgggggaaagatttatcggtgaaggatcggcccgcgtctgattagatagttggtggggtaatggcctaccaagtcgacgatcagtagctggtttgagaggatgatcagcaacactgggactgagacacggcccagactcctacgggaggcagcagtggggaatcttagacaatgggcgaaagcctgatctagcgatgccgcgtgagtgacgaaggccttagggtcgtaaagctctttcgccagggatgataatgacagtacctggtaaagaagtcccggctaactccgtgccagcagccgcggtaatacggaggggactagcgttgttcggaattactgggcgtaaagcgcgcgtaggcggattagtcagtcaggggtgaaatcccggggctcaaccccggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatctggatcgcggttttccgagaggaattccttcagttcggctggatccaagacaggtgctgcatggctgtcgtcagctcgtgtcgtgagatgttcggttaagtccggcaacgagcgcaacccacgtccttagttgccagcattcagttgggcactctagggaaactgccgatgataagtcggaggaaggtgtggatgacgtcaagtcctcatggcccttacgggttgggctacacacgtgctacaatggcagtgacaatgggttaatcccaaaaagctgtctcagttcggattgtcctctgcaactcgagggcatgaagttggaatcgctagtaatcgcagaacagcatgctgcggtgaatacgttcccgggccttgtacacaccgcccgtcacaccatgggagttgggtttacccgaagacggtgcgccaacctgcaaagggggcagctggccacggtaagctcagcgactggggtgaagtcgtaacaaggtagccgtaggggaacctgcggctggatcacctcctttcta

SEQ ID NO: 5243 - DNA, 1473 bp, Maritimibacter sp. HL-12
  ref <308>: DATABASE ACCESSION NUMBER: NCBI ACCESSION: NZ_FXBQ01000001.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcttaacacatgcaagtcgagcgaggccttcgggcctagcggcggacgggtgagtaacgcgtgggaacgtgcctttctctacggaatagtcccgggaaactgggtttaataccgtatacgcccttcgggggaaagatttatcggagagagatcggcccgcgtctgattaggtagttggtggggtaatggcctaccaagccgacgatcagtagctggtttgagaggatgatcagccacactgggactgagacacggcccagactcctacgggaggcagcagtggggaatcttagacaatgggcgcaagcctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctggtcgcggttccgagagatcggatccttcagttcggctggaccagtgacaggtgctgcatggctgtcgtcagctcgtgtcgtgagatgttcggttaagtccggcaacgagcgcaacccacgtccttagttgccagcaggttaagctgggcactctagggaaactgcccgtgataagcgggaggaaggtgtggatgacgtcaagtcctcatggcccttacgggttgggctacacacgtgctacaatggtagtgacaatgggttaatccccaaaagctatctcagttcggattgtcgtctgcaactcgacggcatgaagtcggaatcgctagtaatcgcgtaacagcatgacgcggtgaatacgttcccgggccttgtacacaccgcccgtcacaccatgggagttgggtttacccgacggccgtgcgctaacctttcgaggaggcagcggaccacggtaggctcagcgactggggtgaagtcgtaacaaggtagccgtaggggaacctgcggctggatcacctcctttctaa

SEQ ID NO: 5244 - DNA, 1528 bp, Marivirga sericea
  ref <308>: DATABASE ACCESSION NUMBER: NCBI ACCESSION: NZ_FXAW01000008.1
  ref <309>: DATABASE ENTRY DATE: 2019-04-01
  ref <313>: RELEVANT RESIDUES IN SEQ ID NO: (1)..(1528)
tacaatggagagtttgatcctggctcaggatgaacgctagcggcaggcctaatacatgcaagtcgaacgggattctagacttcggtttagatgagagtggcgcacgggtgcgtaacgcgtatgcaacctaccttttacagggggatagctcggggaaactcgaattaatacctcatggtatcataaaaccgcatggtttaatgattaaagatttatcggtaaaagatgggcatgcgtctgattagttagatggcggggtaacggcccaccatgacgatgatcagtaggggttctgagaggatgatcccccacactggtactgagacacggaccagactcctacgggaggcagcagtagggaatattggtcaatgggcgagagcctgaaccagccatgccgcgtgtaggatgacggccttctgggttgtaaactacttttctacaggaagaaaaagcttatgcgtaagcaattgacggtactgtaggaataagcaccggctaactccgtgccagcagccgcggtaatacggagggtgcgagcgttgtccggatttattgggtttaaagggtgcgtaggcggctctttaagtcagtggtgaaagcccgcagcttaactgcggaactgccattgatactggagagcttgagtacggttgaagtaggcggaatttatggtgtagcggtgaaatgcatagataccataaagaacaccgatagcgtaggcagcttactaagccgtaactgacgctgaggcacgaaagcatggggagcgaacaggattagataccctggtagtccatgccgtaaacgatgatcactcgctgttagcgatatactgttagcggccaagcgaaagcgttaagtgatccacctggggagtacgtccgcaaggatgaaactcaaaggaattgacgggggtccgcacaagcggtggagcatgtggtttaattcgatgatacgcgaggaaccttacctgggctagaatgcccttgacagctttagagatagagttttccttcgggacaaggtgcaaggtgctgcatggctgtcgtcagctcgtgccgtgaggtgttgggttaagtcccgcaacgagcgcaacccctattcttagttgccagcatgtaatgatggggactctaaggagactgcctgcgcaagcagagaggaaggaggggacgacgtcaagtcatcatggcccttacgtccagggctacacacgtgctacaatggtgcatacagagggtagcaagctggtaacagcaagccaatctcaaaaagtgcatctcagttcggattggggtctgcaactcgaccctatgaagttggaatcgctagtaatcgcgtatcagcaatgacgcggtgaatacgttcccggaccttgtacacaccgcccgtcaagccatgggagttgggaggacctgaagatggttgccgcaaggcgctgtttagggttaaaccagcgactagggctaagtcgtaacaaggtagccgtaccggaaggtgtggctggaacacctcctttctggag

SEQ ID NO: 5245 - DNA, 1528 bp, Marivirga tractuosa
  ref <308>: DATABASE ACCESSION NUMBER: NCBI ACCESSION: NC_014759.1
  ref <309>: DATABASE ENTRY DATE: 2019-04-01
  ref <313>: RELEVANT RESIDUES IN SEQ ID NO: (1)..(1528)
tacaatggagagtttgatcctggctcaggatgaacgctagcggcaggcctaatacatgcaagtcgaacgggattctagacttcggtttagatgagagtggcgcacgggtgcgtaacgcgtatgcaacctaccttttacagggggatagctcggggaaactcgaattaataccccatggtatcataagatcgcatggtctaatgattaaagatttatcggtaaaagatgggcatgcgtctgattagctagatggcggggtaacggcccaccatggcgatgatcagtaggggttctgagaggatgatcccccacactggtactgagacacggaccagactcctacgggaggcagcagtagggaatattggacaatgggcgagagcctgatccagccatgccgcgtgtaggatgacggccttctgggttgtaaactacttttctacaggaagaaaaagcttatgcgtaagcaattgacggtactgtaggaataagcaccggctaactccgtgccagcagccgcggtaatacggagggtgcgagcgttgtccggatttattgggtttaaagggtgcgtaggcggctctttaagtcagtggtgaaagcccgcagcttaactgtggaactgccattgatactggagagcttgagtacggttgaagtaggcggaatttatggtgtagcggtgaaatgcatagataccataaagaacaccgatagcgtaggcagcttactaagccgtaactgacgctgaggcacgaaagcatggggagcgaacaggattagataccctggtagtccatgccgtaaacgatgatcactcgctgttagcgatatactgttagcggccaagcgaaagcgttaagtgatccacctggggagtacgtccgcaaggatgaaactcaaaggaattgacgggggtccgcacaagcggtggagcatgtggtttaattcgatgatacgcgaggaaccttacctgggctagaatgcccttgacagctttagagatagagttttccttcgggacaaggtgcaaggtgctgcatggctgtcgtcagctcgtgccgtgaggtgttgggttaagtcccgcaacgagcgcaacccctattcttagttgccagcatgtaatgatggggactctaaggagactgcctgcgcaagcagagaggaaggaggggacgacgtcaagtcatcatggcccttacgtccagggctacacacgtgctacaatggtgcatacagagggtagcgagccggcaacggcaagccaatctcaaaaagtgcatctcagttcggattggggtctgcaactcgaccctatgaagttggaatcgctagtaatcgcgtatcagcaatgacgcggtgaatacgttcccggaccttgtacacaccgcccgtcaagccatgggagttgggaggacctgaagatggttgccgcaaggcgctgtttagggttaaaccagcgactagggctaagtcgtaacaaggtagccgtaccggaaggtgtggctggaacacctcctttctggag

SEQ ID NO: 5246 - DNA, 1469 bp, Marivita cryptomonadis
  ref <308>: DATABASE ACCESSION NUMBER: NCBI ACCESSION: NZ_JFKD01000051.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgagaccttcgggtctagcggcggacgggttagtaacgcgtgggaacgtacccttttctaaggaatagccactggaaacggtgagtaatgccttatacgcccttcgggggaaagatttatcggagaaggatcggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgcctgtgaagataatgactgtagcaggtaaagaaaccccggctaactccgtgccagcagccgcggtaatacggagggggttagcgttgttcggaattactgggcgtaaagcgcgcgtaggcggacatttaagtcagaggtgaaatcccagggctcaaccctggaactgcctttgatactgggtgtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 5247 - DNA, 1469 bp, Marivita geojedonensis
  ref <308>: DATABASE ACCESSION NUMBER: NCBI ACCESSION: NZ_PVTN01000050.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgagaccttcgggtctagcggcggacgggttagtaacgcgtgggaacgtgcccttttctacggaatagcctcgggaaactgagagtaataccgtatacgcccttcgggggaaagatttatcggagaaggatcggcccgcgttagattaggtagttggtggggtaatggcctaccaagcctacgatctatagctggtttgagaggatgatcagcaacactgggactgagacacggcccagactcctacgggaggcagcagtggggaatcttagacaatgggggcaaccctgatctagccatgccgcgtgagtgatgaaggccctagggtcgtaaagctctttcgcctgtgaagataatgactgtagcaggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcccttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 5248 - DNA, 1467 bp, Marivita hallyeonensis
  ref <308>: DATABASE ACCESSION NUMBER: NCBI ACCESSION: NZ_FQXC01000015.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgaaccttcgggttagcggcggacgggttagtaacgcgtgggaacgtacccttttctaaggaatagccactggaaacggtgagtaatgccttatacgcccttcgggggaaagatttatcggagaaggatcggcccgcgttagattaggtagttggtggggtaatggcctaccaagcctacgatctatagctggtttgagaggatgatcagcaacactgggactgagacacggcccagactcctacgggaggcagcagtggggaatcttagacaatgggcgcaagcctgatctagccatgccgcgtgagtgatgaaggccctagggtcgtaaagctctttcgcctgtgaagataatgactgtagcaggtaaagaaaccccggctaactccgtgccagcagccgcggtaatacggagggggttagcgttgttcggaattactgggcgtaaagcgcgcgtaggcggacacttaagtcaggggtgaaatcccggggctcaaccccggaactgcccttgatactgggtgtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggtggtgacagtgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaacctttcgagggggcagctggccacggtaggctcagcgactggggtgaagtcgtaacaaggtagccgtaggggaacctgcggctggatcacctcctttctaa

SEQ ID NO: 5249 - DNA, 1460 bp, Marivivens niveibacter
  ref <308>: DATABASE ACCESSION NUMBER: NCBI ACCESSION: NZ_MSPP01000010.1
  ref <309>: DATABASE ENTRY DATE: 2019-04-01
  ref <313>: RELEVANT RESIDUES IN SEQ ID NO: (1)..(1460)
caacttgagagtttgatcctggctcagaacgaacgctggcggcaggcctaacacatgcaagtcgaacgagatcttcggatctagtggcggacgggttagtaacgcgtgggaacgtacccttcactacggaatagtcctgggaaactgggtttaataccgtatacgcccttcgggggaaagaatttcggtgagggatcggcccgcgttagattagttagttggtggggtaacggcctaccaagactacgatctatagctggtttgagaggatgatcagcaacactgggactgagacacggcccagactcctacgggaggcagcagtggggaatcttagacaatgggggcaaccctgatctagccatgccgcgtgagtgacgaaggccttagggtcgtaaagctctttcgcctgtgaagataatgactgtagcaggtaaagaaaccccggctaactccgtgccagcagccgcggtaatacggagggggttagcgttgttcggaattactgggcgtaaagcgcacgtaggcggactggaaagttagaggtgaaatcccggggctcaacctcggaactgcctttaaaactatcagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcaggttgcttgcaacttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacacccttagttgccaattatggaactctaagggaactgcccgtgataagcgggaggaaggtgtggatgacgtcaagtcctcatggcccttacgggttgggctacacacgtgctacaatggcatctacagtgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgacggccgtgcgctaacccttttgggaggcagcggaccacggtaggctcagcgactggggtgaagtcgtaacaaggtagccgtaggggaacctgcggctggatcacctcctttctaa

SEQ ID NO: 5250 - DNA, 1468 bp, Marivivens sp. JLT3646
  ref <308>: DATABASE ACCESSION NUMBER: NCBI ACCESSION: NZ_CP018572.1
  ref <309>: DATABASE ENTRY DATE: 2019-04-01
  ref <313>: RELEVANT RESIDUES IN SEQ ID NO: (1)..(1468)
tcaacttgagagtttgatcctggctcagaacgaacgctggcggcaggcctaacacatgcaagtcgaacgggatcttcggatctagtggcggacgggttagtaacgcgtgggaacgtacccttttctacggaatagcctcgggaaactgagagtaataccgtatacgcccttcgggggaaagatttatcggagaaggatcggcccgcgtaagattagatagttggtggggtaatggcctaccaagtctacgatctttagctggtttgagaggatgatcagcaacactgggactgagacacggcccagactcctacgggaggcagcagtggggaatcttagacaatgggggaaaccctgatctagccatgccgcgtgagtgacgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggactggaaagttgggggtgaaatcccggggctcaaccccggaacggcctccaaaactatcagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcagagggcttgccctttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacctttgacatcctgtgctaacccgagagatcgggcgttcacttcggtgacgcagtgacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacaggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgacggccgtgcgccaacccgcaagggaggcagcggaccacggtaggctcagcgactggggtgaagtcgtaacaaggtagccgtaggggaacctgcggctggatcacctcctttctaa

SEQ ID NO: 5251 - DNA, 1528 bp, Marmoricola aurantiacus
  ref <308>: DATABASE ACCESSION NUMBER: NCBI ACCESSION: NZ_RKHO01000001.1
  ref <309>: DATABASE ENTRY DATE: 2019-04-01
  ref <313>: RELEVANT RESIDUES IN SEQ ID NO: (1)..(1528)
ttcaatggagagtttgatcctggctcaggacgaacgctggcggcgtgcttaacacatgcaagtcgagcggtaaggcccttcggggtacacgagcggcgaacgggtgagtaacacgtgagcaatctgccctgcactttgggataaccaccggaaacggtggctaataccggatatgacctggcgcggcatcgcgttgggtggaaagttctggcggtgcaggatgagctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcgcagacgaagcgaaagtgacggtatgcgcagaagaagcaccggccaactacgtgccagcagccgcggtaatacgtagggtgcgagcgttgtccggaattattgggcgtaaagggctcgtaggcggtttgttgcgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctaggtttgacatacaccagaagcccctggagacaggggtctctttggacactggtgtacaggtggtgcatggctgtcgtcagctcgtgtcgtgagatgttgggttaagtcccgcaacgagcgcaaccctcgtcttatgttgccagcacgtcatggtggggactcataagagactgccggggtcaactcggaggaaggtggggatgacgtcaagtcatcatgccccttatgcctagggcttcacgcatgctacaatggccggtacaaagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagttggcaacacccgaagccagtggcccaaccgtttacggagggagctgtcgaaggtggggcgagcgattgggacgaagtcgtaacaaggtagccgtaccggaaggtgcggctggatcacctcctttctaaggag

SEQ ID NO: 5252 - DNA, 1531 bp, Marmoricola ginsengisoli
  ref <308>: DATABASE ACCESSION NUMBER: NCBI ACCESSION: NZ_RJSE01000006.1
  ref <309>: DATABASE ENTRY DATE: 2019-04-01
  ref <313>: RELEVANT RESIDUES IN SEQ ID NO: (1)..(1531)
ttcaatggagagtttgatcctggctcaggacgaacgctggcggcgtgcttaacacatgcaagtcgagcggtaaggctccttcgggagtacacgagcggcgaacgggtgagtaacacgtgagcaatctgcccttcactttgggataacttccggaaacggaagctaataccgaatacgaccacttcacgcatgtgatggtggtggaaagttccggcggtgaaggatgagctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgactgccttcgggttgtaaacctctttcagcggggacgaagcgaaagtgacggtacccgcagaagaagcaccggccaactacgtgccagcagccgcggtaatacgtagggtgcgagcgttgtccggaattattgggcgtaaagggctcgtaggcggtttgtcacgtcgggagtgaaaactcagggctcaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctaggtttgacatatgtgagaagcctctagagatagaggtctctttggacactcatatacaggtggtgcatggctgtcgtcagctcgtgtcgtgagatgttgggttaagtcccgcaacgagcgcaaccctcgtcttatgttgccagcacgtaatggtggggactcataagagactgccggggtcaactcggaggaaggtggggatgacgtcaagtcatcatgccccttatgcctagggcttcacgcatgctacaatggccggtacaaagggctgcgataccgcaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagttggcaacacccgaagccagtggcccaaccgtttacggagggagctgtcgaaggtggggcgagcgattgggacgaagtcgtaacaaggtagccgtaccggaaggtgcggctggatcacctcctttctaaggag

SEQ ID NO: 5253 - DNA, 1531 bp, Marmoricola pocheonensis
  ref <308>: DATABASE ACCESSION NUMBER: NCBI ACCESSION: NZ_RJSF01000049.1
  ref <309>: DATABASE ENTRY DATE: 2019-04-01
  ref <313>: RELEVANT RESIDUES IN SEQ ID NO: (1)..(1531)
ttcaacggagagtttgatcctggctcaggacgaacgctggcggcgtgcttaacacatgcaagtcgagcggtaaggccccttcgggggtacacgagcggcgaacgggtgagtaacacgtgagcaatctgcccttcacatcgggataactccgggaaaccgaagctaataccgaatacgaccacttcaggcatctgatggtggtggaaagttccggcggtgaaggatgagctcgcggcctatcagcttgttggtggggtaacggcccaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagcagggacgaagcgcaagtgacggtacctgcagaagaagcaccggccaactacgtgccagcagccgcggtaatacgtagggtgcgagcgttgtccggaattattgggcgtaaagggctcgtaggcggtctgttgcgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctaggtttgacatatacgagaagcctctagagatagaggtctctttggacactcgtatacaggtggtgcatggctgtcgtcagctcgtgtcgtgagatgttgggttaagtcccgcaacgagcgcaaccctcgtcttatgttgccagcacgtcatggtggggactcataagagactgccggggtcaactcggaggaaggtggggatgacgtcaagtcatcatgccccttatgcctagggcttcacgcatgctacaatggccggtacaaagggctgcgaaatcgcaagatggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagttggcaacacccgaagccagtggcccaaccgtttacggagggagctgtcgaaggtggggcgagcgattgggacgaagtcgtaacaaggtagccgtaccggaaggtgcggctggatcacctcctttctaaggag

SEQ ID NO: 5254 - DNA, 1531 bp, Marmoricola solisilvae
  ref <308>: DATABASE ACCESSION NUMBER: NCBI ACCESSION: NZ_RJSG01000002.1
  ref <309>: DATABASE ENTRY DATE: 2019-04-01
  ref <313>: RELEVANT RESIDUES IN SEQ ID NO: (1)..(1531)
ttcaatggagagtttgatcctggctcaggacgaacgctggcggcgtgcttaacacatgcaagtcgagcggtaaggctccttcgggagtacacgagcggcgaacgggtgagtaacacgtgagcaatctgcccttcactttgggataaccctcggaaacgagagctaataccgaatacgaccacttcaggcatctgatggtggtggaaagttccggcggtgaaggatgagctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgactgccttcgggttgtaaacctctttcagcggggacgaagcgcaagtgacggtacccgcagaagaagcaccggccaactacgtgccagcagccgcggtaatacgtagggtgcgagcgttgtccggaattattgggcgtaaagggctcgtaggcggtttgtcacgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctaggtttgacatatacgagaagcctctagagatagaggtctctttggacactcgtatacaggtggtgcatggctgtcgtcagctcgtgtcgtgagatgttgggttaagtcccgcaacgagcgcaaccctcgtcttatgttgccagcacgtaatggtggggactcataagagactgccggggtcaactcggaggaaggtggggatgacgtcaagtcatcatgccccttatgcctagggcttcacgcatgctacaatggccggtacaaagggctgcgataccgcaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagttggcaacacccgaagccagtggcccaaccgtttacggagggagctgtcgaaggtggggcgagcgattgggacgaagtcgtaacaaggtagccgtaccggaaggtgcggctggatcacctcctttctaaggag

SEQ ID NO: 5255 - DNA, 1530 bp, Marmoricola sp. 4Q3S-7
  ref <308>: DATABASE ACCESSION NUMBER: NCBI ACCESSION: NZ_RDBE01000003.1
  ref <309>: DATABASE ENTRY DATE: 2019-04-01
  ref <313>: RELEVANT RESIDUES IN SEQ ID NO: (1)..(1530)
ttcaacggagagtttgatcctggctcaggacgaacgctggcggcgtgcttaacacatgcaagtcgagcggtaaggctccttcgggagtacacgagcggcgaacgggtgagtaacacgtgagcaatctgcccttcacactgggataactcccggaaacgggtgctaataccggatacgaccacttcagtcatctgatggtggtggaaagctccggcggtggaggatgagctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcgaaagcctgatccagcaacgccgcgtgagggacgacggccttcgggttgtaaacctctttcagcagggacgaagcgcaagtgacggtacctgcagaagaagcaccggccaactacgtgccagcagccgcggtaatacgtagggtgcgagcgttgtccggaattattgggcgtaaagggctcgtaggcggtctgtcgcgtcgggagtgaaaactcagggcttaaccctgagcctgctttcgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacaggattagataccctggtagtccacaccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttacctaggtttgacatacgtgagaagcctctagagatagaggtctctttggacactcatgtacaggtggtgcatggctgtcgtcagctcgtgtcgtgagatgttgggttaagtcccgcaacgagcgcaaccctcgtcctatgttgccagcggataacgccggggactcataggagactgccggggtcaactcggaggaaggtggggatgacgtcaagtcatcatgccccttatgcctagggcttcacgcatgctacaatggccggtacaaagggctgcgataccgcaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagttggcaacacccgaagccagtggcccaacccttgtggggggagctgtcgaaggtggggcgagcgattgggacgaagtcgtaacaaggtagccgtaccggaaggtgcggctggatcacctcctttctaaggag

SEQ ID NO: 5256 - DNA, 1495 bp, Martelella endophytica
  ref <308>: DATABASE ACCESSION NUMBER: NCBI ACCESSION: NZ_CP010803.1
  ref <309>: DATABASE ENTRY DATE: 2019-04-01
  ref <313>: RELEVANT RESIDUES IN SEQ ID NO: (1)..(1495)
tcattcaacttgagagtttgatcctggctcaggacgaacgctggcggcaggcttaacacatgcaagtcgaacgatccttcgggatagtggcagacgggtgagtaacgcgtgggaatctaccttttggtacggaatagctccgggaaactggaattaataccgtatgtgtccttcgggagaaagatttatcgccaagagatgagcccgcgtttgattaggtagttggtggggtaatggcctaccaagccgacgatcaatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcgccggtgaagataatgactgtagccggtaaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgatagctagccgtcgggttgcatgcaattcggtggcgcagttaacgcattaagctatccgcctggggagtacggtcgcaagattaaaactcaaaggaattgacgggggcccgcacaagcggtggagcatgtggtttaattcgaagcaacgcgcagaaccttaccagcccttgacatttggtgctacctggagagatccagggttccttcgggacgccaggacaggtgctgcatggctgtcgtcagctcgtgtcgtgagatgttgggttaagtcccgcaacgagcgcaaccctcgcccctagttgccagcatttggttgggcactctagggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgttctctgcaactcgagagcatgaagttggaatcgctagtaatcgcggatcagcatgccgcggtgaatacgttcccgggccttgtacacaccgcccgtcacaccatgggagttggttctacccgaaggcgctgcgctaaccgcaagggggcaggcgaccacggtagggtcagcgactggggtgaagtcgtaacaaggtagccgtaggggaacctgcggctggatcacctcctttctaaggaagcg

SEQ ID NO: 5257 - DNA, 1406 bp, Martelella mediterranea
  ref <308>: DATABASE ACCESSION NUMBER: NCBI ACCESSION: NZ_PVUG01000040.1
  ref <309>: DATABASE ENTRY DATE: 2019-04-01
  ref <313>: RELEVANT RESIDUES IN SEQ ID NO: (1)..(1406)
ggtgagtggcagacgggtgagtaacgcgtgggaatctaccttttggtacggaatagctccgggaaactggaattaataccgtatgtgtccttcgggagaaagatttatcgccaggagatgagcccgcgtttgattaggtagttggtggggtaatggcctaccaagccgacgatcaatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcgccggtgaagataatgactgtagccggtaaagaagccccggctaacttcgtgccagcagccgcggtaatacgaagggggctagcgttgttcggaattactgggcgtaaagcgcacgtaggcggacatttaagtcaggggtgaaatcccggagctcaactccggaactgcctttgatactgggtgtcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgctgtaaacgatgatagctagccgtcgggcagtatactgttcggtggcgcagttaacgcattaagctatccgcctggggagtacggtcgcaagattaaaactcaaaggaattgacgggggcccgcacaagcggtggagcatgtggtttaattcgaagcaacgcgcagaaccttaccagcccttgacatttggtgctacctggagagatccagggttccttcgggacgccaggacaggtgctgcatggctgtcgtcagctcgtgtcgtgagatgttgggttaagtcccgcaacgagcgcaaccctcgcccctagttgccagcattaagttgggcactctagggggactgccggtgataagccgagaggaaggtggggatgacgtcaagtcctcatggcccttacgggctgggctacacacgtgctacaatggtggtgacagtgggcagcaagcgcgcgagcgcaagctaatctccaaaaaccatctcagttcggattgcactctgcaactcgggtgcatgaagttggaatcgctagtaatcgcggatcagcatgccgcggtgaatacgttcccgggccttgtacacaccgcccgtcacaccatgggagttggttctacccgaaggcgctgcgctaaccgcaagggggcaggcgaccacggtagggtcagcgactggggtgaagtcgtaacaaggtagccgtaggggaacctgcggctggatcacctcctttcta

SEQ ID NO: 5258 - DNA, 1496 bp, Martelella sp. AD-3
  ref <308>: DATABASE ACCESSION NUMBER: NCBI ACCESSION: NZ_CP014275.1
  ref <309>: DATABASE ENTRY DATE: 2019-04-01
  ref <313>: RELEVANT RESIDUES IN SEQ ID NO: (1)..(1496)
tcatacaacttgagagtttgatcctggctcaggacgaacgctggcggcaggcttaacacatgcaagtcgaacgcaccttcgggtgagtggcagacgggtgagtaacgcgtgggaatctaccttttggtacggaatagctccgggaaactggaattaataccgtatgtgccctttgggggaaagatttatcgccaagagatgagcccgcgtttgattaggtagttggtggggtaatggcctaccaagccgacgatcaatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcgccggtgaagataatgactgtagccggtaaagaagccccggctaacttcgtgccagcagccgcggtaatacgaagggggctagcgttgttcggaattactgggcgtaaagcgcacgtaggcggacatttaagtcaggggtgaaatcccggagctcaactccggaactgcctttgatactgggtgtctcgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgatagctagccgtcggtgtgcatgcatatcggtggcgcagttaacgcattaagctatccgcctggggagtacggtcgcaagattaaaactcaaaggaattgacgggggcccgcacaagcggtggagcatgtggtttaattcgaagcaacgcgcagaaccttaccagcccttgacatttggtgctacctggagagatccagggttccttcgggacgccaggacaggtgctgcatggctgtcgtcagctcgtgtcgtgagatgttgggttaagtcccgcaacgagcgcaaccctcgcccctagttgccagcatttggttgggcactctagggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgggtgcatgaagttggaatcgctagtaatcgcggatcagcatgccgcggtgaatacgttcccgggccttgtacacaccgcccgtcacaccatgggagttggttctacccgaaggcgctgcgctaaccttaaagggggcaggcgaccacggtagggtcagcgactggggtgaagtcgtaacaaggtagccgtaggggaacctgcggctggatcacctcctttctaaggaagcg

SEQ ID NO: 5259 - DNA, 1541 bp, Marvinbryantia formatexigens
  ref <308>: DATABASE ACCESSION NUMBER: NCBI ACCESSION: NZ_FNBY01000022.1
  ref <309>: DATABASE ENTRY DATE: 2019-04-01
  ref <313>: RELEVANT RESIDUES IN SEQ ID NO: (1)..(1541)
ttttatttgagagtttgatcctggctcaggatgaacgctggcggcgtgcttaacacatgcaagtcgagcgaagcattttaaatgaagttctcggacggaatttaaaatgactgagcggcggacgggtgagtaacgcgtggataacctgccttatacagggggataacagccagaaatggctgctaataccgcataagcgcacggtaccgcatggtacagtgtgaaaaactccggtggtataagatgggtccgcgttggattaggcagttggcggggtaaaggcccaccaaaccgacgatccatagccggcctgagagggtggacggccacattgggactgagacacggcccagactcctacgggaggcagcagtggggaatattgcacaatgggggaaaccctgatgcagcgacgccgcgtgggtgaagaagtatttcggtatgtaaagccctatcagcagggaagaaaatgacggtacctgaccaagaagccccggctaactacgtgccagcagccgcggtaatacgtagggggcaagcgttatccggatttactgggtgtaaagggagcgtagacggccatgcaagtctggtgtgaaaggcgggggctcaacccccggactgcattggaaactgtatggcttgagtgccggagaggtaagcggaattcctggtgtagcggtgaaatgcgtagatatcaggaggaacaccagtggcgaaggcggcttactggacggtaactgacgttgaggctcgaaagcgtggggagcaaacaggattagataccctggtagtccacgccgtaaacgatgaataccaggtgtcgggggacacggtccttcggtgccgcagcaaacgcactaagtattccacctggggagtacgttcgcaagaatgaaactcaaaggaattgacggggacccgcacaagcggtggagcatgtggtttaattcgaagcaacgcgaagaaccttaccaggtcttgacatccggacgaccggacagtaacgtgtccttcccttcggggcgtccgagacaggtggtgcatggttgtcgtcagctcgtgtcgtgagatgttgggttaagtcccgcaacgagcgcaacccctgttcccagtagccagcattcaggatgggcactctggggagactgccagggataacctggaggaaggcggggatgacgtcaaatcatcatgccccttatgatctgggctacacacgtgctacaatggcgtgaacagagggaagcgaacccgcgagggggagcaaatcccagaaataacgtcccagttcggattgtagtctgcaacccggctacatgaagctggaatcgctagtaatcgcggatcagcatgccgcggtgaatacgttcccgggtcttgtacacaccgcccgtcacaccatgggagtcggaaatgcccgaagtcagtgacccaaccggaaggagggagctgccgaaggcggggccggtaactggggtgaagtcgtaacaaggtagccgtatcggaaggtgcggctggatcacctcctttctagggaa

SEQ ID NO: 5260 - DNA, 1540 bp, Massilia armeniaca
  ref <308>: DATABASE ACCESSION NUMBER: NCBI ACCESSION: NZ_CP028324.1
  ref <309>: DATABASE ENTRY DATE: 2019-04-01
  ref <313>: RELEVANT RESIDUES IN SEQ ID NO: (1)..(1540)
agattgaactgaagagtttgatcctggctcagattgaacgctggcggcatgctttacacatgcaagtcgaacggtaacagggagcttgctccgctgacgagtggcgaacgggtgagtaatatatcggaacgtacccaagagtgggggataacgtagcgaaagttacgctaataccgcatacgatccaaggatgaaagcaggggaccgcaaggccttgtgctcctggagcggccgatatctgattagctagttggtgaggtaaaggctcaccaaggcgacgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggctgtggctaatatccacggctaatgacggtacctgaagaataagcaccggctaactacgtgccagcagccgcggtaatacgtagggtgcaagcgttaatcggaattactgggcgtaaagcgtgcgcaggcggttttgtaagtctgtcgtgaaatccccgggcttaacctgggaatggcgatggagactgcaaggctggaatctggcagaggggggtagaattccacgtgtagcagtgaaatgcgtagagatgtggaggaacaccgatggcgaaggcagccccctgggctaagattgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgctacgcgaaaaaccttacctacccttgacatggcaggaatccctgagagatcggggagtgctcgaaagagaacctgcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttctag

SEQ ID NO: 5261 - DNA, 1543 bp, Massilia aurea
  ref <308>: DATABASE ACCESSION NUMBER: NCBI ACCESSION: NZ_JSAB01000144.1
  ref <309>: DATABASE ENTRY DATE: 2019-04-01
  ref <313>: RELEVANT RESIDUES IN SEQ ID NO: (1)..(1543)
agattgaactgaagagtttgatcctggctcagattgaacgctggcggcatgctttacacatgcaagtcgaacggtaacagggagcttgctccgctgacgagtggcgaacgggtgagtaatatatcggaacgtacccaagagtgggggataacgtagcgaaagttacgctaataccgcatacgatccaaggatgaaagcaggggatcttcggaccttgtgctcctggagcggccgatatctgattagctagttggtgaggtaaaggctcaccaaggcgacgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggtgggggctaatatcctccactaatgacggtacctgaagaataagcaccggctaactacgtgccagcagccgcggtaatacgtagggtgcaagcgttaatcggaattactgggcgtaaagcgtgcgcaggcggttttgtaagtctgtcgtgaaatccccgggctcaacctgggaattgcgatggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaagccacgagagatcgaggtgtgctcgaaagagagccgtaacacaggtgctgcatggctgtcgtcagctcgtgtcgtgagatgttgggttaagtcccgcaacgagcgcaacccttgtcattagttgctacatttagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgcagtctgcaactcgactgcgtgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttcta

SEQ ID NO: 5262 - DNA, 1537 bp, Massilia eurypsychrophila
  ref <308>: DATABASE ACCESSION NUMBER: NCBI ACCESSION: NZ_PDOC01000073.1
  ref <309>: DATABASE ENTRY DATE: 2019-04-01
  ref <313>: RELEVANT RESIDUES IN SEQ ID NO: (1)..(1537)
agattgaactgaagagtttgatcctggctcagattgaacgctggcggcatgccttacacatgcaagtcgaacggcagcgcggggcaacctggcggcgagtggcgaacgggtgagtaatatatcggaacgtgccctggagtgggggataacgcagcgaaagttgcgctaataccgcatacgatctaaggatgaaagcaggggaccgcaaggccttgtgctcctggagcggccgatatctgattagctagttggtggggtaaaggcctaccaaggcatcgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtgtgggctaatatcctgcactaatgacggtacctgaagaataagcaccggctaactacgtgccagcagccgcggtaatacgtagggtgcaagcgttaatcggaattactgggcgtaaagcgtgcgcaggcggttttgtaagtttgtcgtgaaatccccgggctcaacctgggaattgcgatgaagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaagccacgagagatcgaggtgtgctcgaaagagagccgtaacacaggtgctgcatggctgtcgtcagctcgtgtcgtgagatgttgggttaagtcccgcaacgagcgcaacccttgtcattagttgctacgaaagagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttcta

SEQ ID NO: 5263 - DNA, 923 bp, Massilia glaciei
  ref <308>: DATABASE ACCESSION NUMBER: NCBI ACCESSION: NZ_PXWF02000348.1
  ref <309>: DATABASE ENTRY DATE: 2019-04-01
  ref <313>: RELEVANT RESIDUES IN SEQ ID NO: (1)..(923)
tcaacctgggaattgcgatggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaagccacgagagatcgaggtgtgctcgaaagagaaccgtaacacaggtgctgcatggctgtcgtcagctcgtgtcgtgagatgttgggttaagtcccgcaacgagcgcaacccttgtcattagttgctacgaaagagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttctag

SEQ ID NO: 5264 - DNA, 1539 bp, Massilia lutea
  ref <308>: DATABASE ACCESSION NUMBER: NCBI ACCESSION: NZ_CP035913.1
  ref <309>: DATABASE ENTRY DATE: 2019-04-01
  ref <313>: RELEVANT RESIDUES IN SEQ ID NO: (1)..(1539)
agattaaactgaagagtttgatcctggctcagattgaacgctggcggcatgctttacacatgcaagtcgaacggtaacagggagcttgctccgctgacgagtggcgaacgggtgagtaatatatcggaacgtgcccaagagtgggggataacgtagcgaaagttacgctaataccgcatacgatctaaggatgaaagtgggggatcgcaagacctcatgctcctggagcggccgatatctgattagctagttggtgaggtaaaagctcaccaaggcgacgatcagtagctggtctgagaggacgaccagccacactggaactgagacacggtccagactcctacgggaggcagcagtggggaattttggacaatgggggcaaccctgatccagcaatgccgcgtgagtgaagaaggccttcgggttgtaaagctcttttgtcagggaagaaaagggtacggctaatatccgtgcctcatgacggtacctgaagaataagcaccggctaactacgtgccagcagccgcggtaatacgtagggtgcaagcgttaatcggaattactgggcgtaaagcgtgcgcaggcggttttgtaagtctgttgtgaaatccccgggcttaacctgggaatggcaatggagactgcaaggctagagtttggcagaggggggtagaattccacgtgtagcagtgaaatgcgtagagatgtggaggaacaccgatggcgaaggcagccccctgggtcaagactgacgctcatgcacgaaagcgtggggagcaaacaggattagataccctggtagtccacgccctaaacgatgtctactagttgttgggtcttaattgacttagtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtcaggaatcctggagagatccgggagtgcccgaaagggaacctgaacacaggtgctgcatggctgtcgtcagctcgtgtcgtgagatgttgggttaagtcccgcaacgagcgcaacccttgtcattagttgctacgaaagagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttcta

SEQ ID NO: 5265 - DNA, 1543 bp, Massilia oculi
  ref <308>: DATABASE ACCESSION NUMBER: NCBI ACCESSION: NZ_CP029343.1
  ref <309>: DATABASE ENTRY DATE: 2019-04-01
  ref <313>: RELEVANT RESIDUES IN SEQ ID NO: (1)..(1543)
agattgaactgaagagtttgatcctggctcagattgaacgctggcggcatgctttacacatgcaagtcgaacggtaacagggagcttgctccgctgacgagtggcgaacgggtgagtaatatatcggaacgtacccagaagtgggggataacgtagcgaaagttacgctaataccgcatacgatccacggatgaaagtaggggaccttcgggccttatgcttttggagcggccgatatctgattagctagttggtagggtaaaggcctaccaaggcgacgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggtagaggctaatatcctttgctaatgacggtacctgaagaataagcaccggctaactacgtgccagcagccgcggtaatacgtagggtgcaagcgttaatcggaattactgggcgtaaagcgtgcgcaggcggttttgtaagtctgacgtgaaatccccgggctcaacctgggaattgcgttggagactgcaaggctagaatctggcagagggggggtagaattccacgtgtagcagtgaaatgcgtagagatgtggaggaacaccgatggcgaaggcagccccctgggtcaagattgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaatgccgaagagatttggcagtgctcgaaagagaaccgtaacacaggtgctgcatggctgtcgtcagctcgtgtcgtgagatgttgggttaagtcccgcaacgagcgcaacccttgtcattagttgctacattcagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgtagtctgcaactcgactacgtgaagttggaatcgctagtaatcgcggatcagcatgccgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttct

SEQ ID NO: 5266 - DNA, 1538 bp, Massilia sp. K1S02-61
  ref <308>: DATABASE ACCESSION NUMBER: NCBI ACCESSION: NZ_QYUP01000153.1
  ref <309>: DATABASE ENTRY DATE: 2019-04-01
  ref <313>: RELEVANT RESIDUES IN SEQ ID NO: (1)..(1538)
agattaaactgaagagtttgatcctggctcagattgaacgctggcggcatgctttacacatgcaagtcgaacggcagcgcggggcaacctggcggcgagtggcgaacgggtgagtaatatatcggaacgtacccaagagtgggggataacgtagcgaaagttacgctaataccgcatacgatccaaggatgaaagcaggggaccgcaaggccttgtgctcctggagcggccgatatctgattagctagttggtgaggtaaaggctcaccaaggcgacgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggtgcgggctaatatcccgcgctaatgacggtacctgaagaataagcaccggctaactacgtgccagcagccgcggtaatacgtagggtgcaagcgttaatcggaattactgggcgtaaagcgtgcgcaggcggttttgtaagtctgtcgtgaaatccccgggctcaacctgggaattgcgatggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggcaggaatcccggagagatttgggagtgctcgaaagagaacctgcacacaggtgctgcatggctgtcgtcagctcgtgtcgtgagatgttgggttaagtcccgcaacgagcgcaacccttgtcattagttgctacgaaagagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttctag

SEQ ID NO: 5267 - DNA, 1537 bp, Massilia sp. SOD
  ref <308>: DATABASE ACCESSION NUMBER: NCBI ACCESSION: NZ_RXLQ01000046.1
  ref <309>: DATABASE ENTRY DATE: 2019-04-01
  ref <313>: RELEVANT RESIDUES IN SEQ ID NO: (1)..(1537)
agattgaactgaagagtttgatcctggctcagattgaacgctggcggcatgccttacacatgcaagtcgaacggcagcgcggggcaacctggcggcgagtggcgaacgggtgagtaatatatcggaacgtaccctggagtgggggataacgtagcgaaagttacgctaataccgcatacgatctaaggatgaaagtgggggatcgcaagacctcatgctcctggagcggccgatatctgattagctagttggtggggtaaaggcctaccaaggcatcgatcagtagctggtctgagaggacgaccagccacactggaactgagacacggtccagactcctacgggaggcagcagtggggaattttggacaatgggcgaaagcctgatccagcaatgccgcgtgagtgaagaaggccttcgggttgtaaagctcttttgtcagggaagaaacggtggaggctaatatcctctgctaatgacggtacctgaagaataagcaccggctaactacgtgccagcagccgcggtaatacgtagggtgcaagcgttaatcggaattactgggcgtaaagcgtgcgcaggcggttttgtaagtctgtcgtgaaatccccgggctcaacctgggaattgcgatggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacggaagccacgagagatcgaggcgtgctcgaaagagagccgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtaggtagcttaaccgcaaggggggcgcttaccacggtaggattcgtgactggggtgaagtcgtaacaaggtaaccgtatcggaaggtgcggctggatcacctcctttcta

SEQ ID NO: 5268 - DNA, 1542 bp, Massilia sp. WG5
  ref <308>: DATABASE ACCESSION NUMBER: NCBI ACCESSION: NZ_CP012640.2
  ref <309>: DATABASE ENTRY DATE: 2019-04-01
  ref <313>: RELEVANT RESIDUES IN SEQ ID NO: (1)..(1542)
agattaaactgaagagtttgatcctggctcagattgaacgctggcggcatgctttacacatgcaagtcgaacggcagcgcggggcaacctggcggcgagtggcgaacgggtgagtaatacatcggaacgtacccagaagtgggggataacgtagcgaaagttacgctaataccgcatacgttctacggaagaaagtgggggatcttcggacctcatgcttttggagcggccgatgtctgattagctagttggtgaggtaaaggctcaccaaggcgacgatcagtagctggtctgagaggacgaccagccacactgggactgagacacggcccagactcctacgggaggcagcagtggggaattttggacaatgggcgcaagcctgatccagcaatgccgcgtgagggaagaaggccttcgggttgtaaagctctttcggccgggaagaaacggttggggctaatatcctcggctaatgacggtacctgcagaagaagcaccggctaactacgtgccagcagccgcggtaatacgtagggtgcaagcgttaatcggaattactgggcgtaaagcgtgcgtaggcggttttgtaagtctgaggtgaaatccccgggcttaacccgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtcaggaatccttgagagatcgaggagtgcccgaaagggagcctgaacacaggtgctgcatggctgtcgtcagctcgtgtcgtgagatgttgggttaagtcccgcaacgagcgcaacccttgtcattagttgctacattcagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggatcgcagtctgcaactcgactgcgtgaagttggaatcgctattaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttctag

SEQ ID NO: 5269 - DNA, 1540 bp, Massilia sp. YMA4
  ref <308>: DATABASE ACCESSION NUMBER: NCBI ACCESSION: NZ_CP030092.1
  ref <309>: DATABASE ENTRY DATE: 2019-04-01
  ref <313>: RELEVANT RESIDUES IN SEQ ID NO: (1)..(1540)
agattgaactgaagagtttgatcctggctcagattgaacgctggcggcatgctttacacatgcaagtcgaacggtaacagggagcttgctccgctgacgagtggcgaacgggtgagtaatatatcggaacgtgcccaagagtgggggataacgtagcgaaagttacgctaataccgcatacgatccaaggatgaaagcaggggaccgcaaggccttgtgctcctggagcggccgatatctgattagctagttggtgaggtaaaggctcaccaaggcgacgatcagtagctggtctgagaggacgaccagccacactgggactgagacacggcccagactcctacgggaggcagcagtggggaattttggacaatgggcgcaagcctgatccagcaatgccgcgtgagtgaagaaggccttcgggttgtaaagctcttttgtcagggaagaaacggtcgtggctaatatccacggctaatgacggtacctgaagaataagcaccggctaactacgtgccagcagccgcggtaatacgtagggtgcaagcgttaatcggaattactgggcgtaaagcgtgcgcaggcggttttgtaagtctgtcgtgaaatccccgggcttaacctgggaatggcgatggagactgcaaggctggaatctggcagaggggggtagaattccacgtgtagcagtgaaatgcgtagagatgtggaggaacaccgatggcgaaggcagccccctgggctaagattgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggcaggaatcccgaagagatttgggagtgctcgaaagagaacctgcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgtaaggagggcgcttaccacggtaggattcgtgactggggtgaagtcgtaacaaggtagccgtatcggaaggtgcggctggatcacctcctttctag

SEQ ID NO: 5270 - DNA, 1070 bp, Massilia yuzhufengensis
  ref <308>: DATABASE ACCESSION NUMBER: NCBI ACCESSION: NZ_FOLD01000064.1
  ref <309>: DATABASE ENTRY DATE: 2019-04-01
  ref <313>: RELEVANT RESIDUES IN SEQ ID NO: (1)..(1070)
gctaatgacggtacctgaagaataagcaccggctaactacgtgccagcagccgcggtaatacgtagggtgcaagcgttaatcggaattactgggcgtaaagcgtgcgcaggcggttttgtaagtctgtcgtgaaagccccgggctcaacctgggaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacaggattagataccctggtagtccacgccctaaacgatgtctactagttgtcgggttttaattaacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggaaggaagtccggagagatctggatgtgcccgaaagggaaccttcacacaggtgctgcatggctgtcgtcagctcgtgtcgtgagatgttgggttaagtcccgcaacgagcgcaacccttgtcattagttgctacatttagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtaggtagcttaaccgcaaggggggcgcttaccacggtaggattcgtgactggggtgaagtcgtaacaaggtagccgtatcggaaggtgcggctggatcacctcctttcta

SEQ ID NO: 5271 - DNA, 1676 bp, Massilibacillus massiliensis
  misc_feature (988)..(988): n is a, c, g, or t
  misc_feature (1335)..(1335): n is a, c, g, or t
  misc_feature (1513)..(1513): n is a, c, g, or t
  ref <308>: DATABASE ACCESSION NUMBER: NCBI ACCESSION: NZ_LT575483.1
  ref <309>: DATABASE ENTRY DATE: 2019-04-01
  ref <313>: RELEVANT RESIDUES IN SEQ ID NO: (1)..(1676)
tttattggagagtttgatcctggctcaggacgaacgctggcggcgtgcctaacacatgcaagtcgaacggaattacgcttaacaccgatttcttaataaaaggttggatgttaagtcgcttatgcggtgaatgaacgaagtgaattcaccacgcataaaaagtgccaaccccataagaattgggtgttgagcgtaatttagtggcgaacgggtgagtaacgcgtagacaacctacccttaagatggggacaacagatcgaaaggtctgctaataccgaatattatagaagaaacgcatgtttcttctataaaagatggcctctatatataagctatcgctaaaggatgggtctgcgtctgattagctagttggtgagataaaagctcaccaaggcaacgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggatcgtaaagctctgttgttaaggacgaatgtatagattgtaaataatgatttataatgacggtacttaacgagaaagccacggctaactacgtgccagcagccgcggtaatacgtaggtggcaagcgttgtccggaattattgggcgtaaagggagcgcaggtgggaatgtaagtcaatcttaaaagtgcggggctcaaccccgtgatgggatagaaactacatttcttgagtgcaggagaggaaagtggaattcctagtgtagcggtgaaatgcgtagatattaggaggaacaccagtggcgaaggcgactttctggactgtaactgacactgaggctcgaaagctaggggagcgaacgggattagataccccggtagtcctagccgtaaacgatgggtactaggtgtaggaggtatcgaccccttctgtgccggagttaacgcncataagtcaagctactaagggcatacggcggatgcctaggcgccaagagccgaagaaggacgcgataagctgcgaaaagtcatggggagccgcaagtaggcattgatccatgaatatccgaatgggggaacccagcagtcgtaatggactgttacccatgcctgagagcatgaggaggtagacccggggaactgaaacatctaagtacccggaggaaaagtaatcaattgagattccctaagtagcggcgagcgaacggggaagagcccaaaccagccaacttcggttgactggggttgaggactgacataaatcagaaatggcttagctgaacgatctgggaaggncgatggacaactggcaaaaattccagtaccaccaataattgtttgagtgatggagtgacacagaaggaagttcgagcatactgatggaatagtatgtctaagcttgtagggtgagagacaggtaaatccgtctcttgaatacctgaggagtgatgggtatctaaggctttggccgagncttgtacacaccgcccgtcacaccacgaaagtcagtcacacccaaagccggtggggtaaccgtaaggagccagccgtctaaggtggggccgatgattggggtgaagtcgtaacaaggtagccgtatcggaaggtgcggctggatcacctcctttctaaggaga

SEQ ID NO: 5272 - DNA, 1561 bp, Massilibacterium senegalense
  ref <308>: DATABASE ACCESSION NUMBER: NCBI ACCESSION: NZ_LN831786.1
  ref <309>: DATABASE ENTRY DATE: 2019-04-01
  ref <313>: RELEVANT RESIDUES IN SEQ ID NO: (1)..(1561)
ttttatttgagagtttgatcctggctcaggatgaacgctggcggcgtgcctaatacatgcaagtcgagcgaaccaacgaggagcttgctcctttgaggttagcggcggacgggtgagtaacacgtgggcaacctgcccttaagactgggataacatcgagaaatcggtgctaataccggataactgattagaccgcatggtctaatgataaaagatggcttcggctatcacttaaggatgggcccgcggcgcattagctagttggtagggtaacagcctaccaaggcaacgatgcgtagccgacctgagagggtgatcggccacattgggactgagacacggcccaaactcctacgggaggcagcagtagggaatcttccgcaatggacgaaagtctgacggagcaacgccgcgtgagtgatgaaggtcttcggatcgtaaaactctgttgttagggaagaacaagtatcgttcaaatagggcggtaccttgacggtacctaaccagaaagccacggctaactacgtgccagcagccgcggtaatacgtaggtggcaagcgttatccggaattattgggcgtaaagcgcgcgcaggcggcttcttaagtctgatgtgaaagcccacggctcaaccgtggagggtcattggaaactggaaagcttgagtgcagaagaggagagtggaattccatgtgtagcggtgaaatgcgtagagatatggaggaacaccagtggcgaaggcgactctctggtctgcaactgacgctgaggcgcgaaagcgtggggagcgaacaggattagataccctggtagtccacgctgtaaacgatgagtgctaggtgtcggggggtccaaccctcggtgctgtcgctaacgcactaagcactccgcctggggagtacggtcgcaagactgaaactcaaaggaattgacgggggcccgcacaagcggtggagcatgtggtttaattcgaagcaacgcgaagaaccttaccaagtcttgacatcccttgcacgctctagagatagagttttccccttcgggggacaaggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacttgggctacacacgtgctacaatgggtgatacaaagggtcgcgaagtcgcaaggcggagctaatcccataaagtcactctcagttcggattgcaggctgcaactcgcctgcatgaagtcggaatcgctagtaatcgcagatcagcatgctgcggtgaatacgttcccgggccttgtacacaccgcccgtcacaccacgagagtttgcaacacccgaagtcggtgaggtaaccttttggaaccagccgccgaaggtggggtagatgattggggtgaagtcgtaacaaggtagccgtatcggaaggtgcggctggatcacctcctttctaaggaa

SEQ ID NO: 5273 - DNA, 1528 bp, Massilimaliae massiliensis
  ref <308>: DATABASE ACCESSION NUMBER: NCBI ACCESSION: NZ_FUHT01000001.1
  ref <309>: DATABASE ENTRY DATE: 2019-04-01
  ref <313>: RELEVANT RESIDUES IN SEQ ID NO: (1)..(1528)
aacaaagagtttgatcctggctcaggacgaacgctgtcggcgcgcctaacacatgcaagtcgaacgaagctgcatcgaacgaattcttcggaaagagattggtacagcttagtggcggacgggtgagtaacgcgtgagtaacctgcctttcagagggggataacgtttggaaacgaacgctaataccgcataacatattaaattcgcatggatttgatatcaaaggagcaatccgctgaaagatggactcgcgtccaattagctagttggtgaggtaacggcccaccaaggcgacgattggtagccggactgagaggttgaacggccacattgggactgagacacggcccagactcctacgggaggcagcagtggggaatattgcacaatgggggaaaccctgatgcagcgacgccgagtgagggaagaaggttttcggattgtaaacctctgtccttggtgaagataatgacggtagccaaggaggaagctacggctaactacgtgccagcagccgcggtaatacgtaggtagcgagcgttgtccggaattactgggtgtaaagggagcgtaggcgggattgcaagttgaatgtcaaatctacgggcttaacccgtagccgcgttcaaaactgcagttcttgagtgaagtagaggcaggcggaattcctagtgtagcggtgaaatgcgtaaatattaggaggaacaccagtggcgaaggcggcctgctgggctttaactgacgctgaggctcgaaagcgtgggtagcaaacaggattagataccctggtagtccacgctgtaaacgatgattactaggtgtgggggggactgaccccttccgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatcgtgcgcatagcctagagataggtgaagcccttcggggcgcatagacaggtggtgcatggttgtcgtcagctcgtgtcgtgagatgttgggttaagtcccgcaacgagcgcaacccttacgtttagttgctacgcaagagcactctagacggactgccgttgacaaaacggaggaaggtggggatgacgtcaaatcatcatgccccttatgacctgggctacacacgtactacaatggctattaacagagggaagcaagatggtgacatggagcaaacccctaaaaatagtctcagttcggattgcaggctgcaacccgcctgcatgaagccggaattgctagtaatcgcggatcagcatgccgcggtgaatacgttcccgggccttgtacacaccgcccgtcacaccatgagagttggcaacacccgaagccgatagtctaaccgcaagggggacgtcgtcgaaggtggggttgatgattggggtgaagtcgtaacaaggtagccgtatcggaaggtgcggctggatcacctcctttcta

SEQ ID NO: 5274 - DNA, 1525 bp, Massilimaliae timonensis
  ref <308>: DATABASE ACCESSION NUMBER: NCBI ACCESSION: NZ_FYDD01000001.1
  ref <309>: DATABASE ENTRY DATE: 2019-04-01
  ref <313>: RELEVANT RESIDUES IN SEQ ID NO: (1)..(1525)
taaagagtttgatcctggctcaggacgaacgctgtcggcgcgcctaacacatgcaagtcgaacgaagttgctttgaatgaattcttcggaaggaatttgattcaacttagtggcggacgggtgagtaacgcgtgagtaacctgcctttcagagggggataacgtctggaaacggacgctaataccgcataacatattggtttcgcatggagctgatatcaaaggagcaatccgctgaaagatggactcgcgtccaattagctagttggtgaggtaacggcccaccaaggcgacgattggtagccggactgagaggttgaacggccacattgggactgagacacggcccagactcctacgggaggcagcagtggggaatattgcacaatgggggaaaccctgatgcagcgacgccgagtgagggaagaaggttttcggattgtaaacctctgtccttggtgaagataatgacggtaaccaaggaggaagctacggctaactacgtgccagcagccgcggtaatacgtaggtagcgagcgttgtccggaattactgggtgtaaagggagcgtaggcgggattgcaagttgaatgttaaatctatgggctcaacccatagccgcgttcaaaactgcagttcttgagtgaagtagaggcaggcggaattcctagtgtagcggtgaaatgcgtaaatattaggaggaacaccagtggcgaaggcggcctgctgggctttaactgacgctgaggctcgaaagcgtgggtagcaaacaggattagataccctggtagtccacgctgtaaacgatgattactaggtgtggggggactgaccccttccgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccggtgcatagcctagagataggtgaagcccttcggggcaccgagacaggtggtgcatggttgtcgtcagctcgtgtcgtgagatgttgggttaagtcccgcaacgagcgcaacccttacgtttagttgctacgcaagagcactctagacggactgccgttgacaaaacggaggaaggtggggatgacgtcaaatcatcatgccccttatgacctgggctacacacgtactacaatggctattaacagagggaagcaagatggtgacatggagcaaacccctaaaaatagtctcagttcggattgcaggctgcaacccgcctgcatgaagccggaattgctagtaatcgcggatcagcatgccgcggtgaatacgttcccgggccttgtacacaccgcccgtcacaccatgagagttggcaacacccgaagccgatagtctaaccgcaagggggacgtcgtcgaaggtggggttgatgattggggtgaagtcgtaacaaggtagccgtatcggaaggtgcggctggatcacctcctttcta

SEQ ID NO: 5275 - DNA, 1533 bp, Massilioclostridium coli
  ref <308>: DATABASE ACCESSION NUMBER: NCBI ACCESSION: NZ_FMIZ01000007.1
  ref <309>: DATABASE ENTRY DATE: 2019-04-01
  ref <313>: RELEVANT RESIDUES IN SEQ ID NO: (1)..(1533)
ttaaattaagagtttgatcctggctcaggacgaacgctggcggcgcgcctaacacatgcaagtcgaacggagatacctgttagatcccttcggggtgacgatggactatcttagtggcggacgggtgagtaacacgtgagcaacctgccttacagagtgggataacgtttggaaacgaacgctaataccgcataacattaacttatcgcatggtaagataatcaaagaaattcgctgtaagatgggctcgcgtctgattagatagttggtgaggtaacggctcaccaagtcgacgatcagtagccggactgagaggttgaacggccacattgggactgagacacggcccagactcctacgggaggcagcagtggggaatattgcacaatgggggaaaccctgatgcagcgacgccgcgtgagggaagaaggttttcggattgtaaacctctgtcttcagggacgatagtgacggtacctgaggaggaagctccggctaactacgtgccagcagccgcggtaatacgtagggagcgagcgttgtccggaattactgggtgtaaagggagcgtaggcgggacagcaagttgaatgtgaaatctatgggctcaacccataaactgcgttcaaaactgttgttcttgagtgaagtagaggtaggcggaattcctagtgtagcggtgaaatgcgtagatattaggaggaacaccagtggcgaaggcggcctactgggctttaactgacgctgaggctcgaaagcgtgggtagcaaacaggattagataccctggtagtccacgctgtaaacgatgattactaggtgtgggggggtcaaccttccgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccaactaacgagatagagatatgttaggtgcccttcggggaaagttgagacaggtggtgcatggttgtcgtcagctcgtgtcgtgagatgttgggttaagtcccgcaacgagcgcaacccttaccattagttgctacgcaagagcactctaatgggactgccgttgacaaaacggaggaaggtggggatgacgtcaaatcatcatgccccttatgacctgggccacacacgtactacaatggctattaacagagggaagcaataccgcgaggaggagcaaacccctaaaaatagtctcagttcggattgcaggctgcaacccgcctgcatgaagccggaattgctagtaatcgcggatcagcatgccgcggtgaatacgttcccgggccttgtacacaccgcccgtcacaccatgagagttggcaacacccgaagccagtagcctaaccgcaaggagggcgctgtcgaaggtggggttgatgattagggtgaagtcgtaacaaggtagccgtatcggaaggtgcggctggatcacctcctttctatgga

SEQ ID NO: 5276 - DNA, 1527 bp, Massiliomicrobiota timonensis
  ref <308>: DATABASE ACCESSION NUMBER: NCBI ACCESSION: NZ_UYXN01000093.1
  ref <309>: DATABASE ENTRY DATE: 2019-04-01
  ref <313>: RELEVANT RESIDUES IN SEQ ID NO: (1)..(1527)
aatggagagtttgatcctggctcaggatgaacgctggcggcgtgcctaatacatgcaagtcggacgcaatgcttcggcattgagtggcgaacgggtgagtaatacataagcaacctgcccctgtgagggggataactgctggaaacggcagctaagaccgcatatgcatacatgacgcatgtcgagtatgttaaatatcccacgggatagcacagggatgggcttatgacgcattagctagctggtgaggtagaggctcaccagggcgacgatgcgtagccggcctgagagggtggacggccacactgggactgagacacggcccagactcctacgggaggcagcagtagggaattttcggcaatgggcgaaagcctgaccgagcaacgccgcgtgaaggaagaagtcattcgtgatgtaaacttctgttataaaggaagaacggcgcctgtagggaatgacaggcgagtgacggtactttatgaggaagccacggctaactacgtgccagcagccgcggtaatacgtaggtggcgagcgttatccggaatcattgggcgtaaagagggagcaggcggcagtgcaggtctgcggtgaaagcccgaagctaaacttcggtaagccgtggaaaccgcacagctagagagcatcagaggatcgcggaattccatgtgtagcggtgaaatgcgtagatatatggaggaacaccagtggcgaaggcggcggtctggggtgcagctgacgctcagtcccgaaagcgtggggagcaaataggattagataccctagtagtccacgccgtaaacgatgagtgctaagtgttgggggtcagacctcggtgctgcagttaacgcaataagcactccgcctgagtagtacgttcgcaagaatgaaactcaaaggaattgacgggggcccgcacaagcggtggagcatgtggtttaattcgaagcaacgcgaagaaccttaccaggtcttgacatggagataaaggctctggagacagagagataggtatatctcacacaggtggtgcatggttgtcgtcagctcgtgtcgtgagatgttgggttaagtcccgcaacgagcgcaacccctgttgccagttgccagcattaggttggggactctggcgagactgcctctgcaaggaggaggaaggcggggatgacgtcaaatcatcatgccccttatgacctgggctacacacgtgctacaatggacggatcagagggaggcgaagccgcgaggtggagcgaaacccagaaacccgttcacagttcggactgcagtctgcaactcgactgcacgaagctggaatcgctagtaatcgcgaatcagcatgtcgcggtgaatacgttctcgggccttgtacacaccgcccgtcacaccatgagagttggtaacacccgaagccggtggcccaaccgcaaggagggagctgtctaaggtgggactgatgattggggtgaagtcgtaacaaggtatccctacgggaacgtggggatggatcacctcctttctagg

SEQ ID NO: 5277 - DNA, 1492 bp, Mastigocladopsis repens
  ref <308>: DATABASE ACCESSION NUMBER: NCBI ACCESSION: NZ_JH992901.1
  ref <309>: DATABASE ENTRY DATE: 2019-04-01
  ref <313>: RELEVANT RESIDUES IN SEQ ID NO: (1)..(1492)
aaaacggagagtttgatcctggctcaggatgaacgctggcggtatgcttaacacatgcaagtcgaacggggtgcttaggcacctagtggcggacgggtgagtaacgcgtgagaatctggcttcaggttcgggacaacagttggaaacgactgctaataccggatgtgccgatgggtaaaagattaattgcctgaagatgagctcgcgtctgattagctagtaggtgtggtaagagcgcacctaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggttcttggattgtaaacctcttttctcagggaagaaatcttgacggtacctgaggaataagcatcggctaactccgtgccagcagccgcggtaatacggaggatgcaagcgttatccggaatgattgggcgtaaagcgtccgcaggtggcaatgaaagtctgctgtcaaagagtttggcttaaccaaataaaggcagtggaaactacatagctagagtgaggtaggggcagagggaattcctggtgtagcggtgaaatgcgtagagatcaggaagaacaccggtggcgaaagcgctctgctggaccacaactgacactgagggacgaaagctaggggagcgaatgggattagataccccagtagtcctagccgtaaacgatgggtactaggcgttgcccgtatcgacccgggcagtgtcgtagctaacgcgttaagtaccccgcctggggagtacgcaggcaactgtgaaactcaaaggaattgacgggggcccgcacaagcggtggagtatgtggtttaattcgatgcaacgcgaagaaccttaccagggcttgacatgtccggaatccccttgaaaggggggagtgccttcgggagccggaacacaggtggtgcatggctgtcgtcagctcgtgtcgtgagatgttgggttaagtcccgcaacgagcgcaaccctcgtttttagttgccagcattaagttgggcactctaaagagactgccggtgacaaaccggaggaaggtggggatgacgtcaagtcagcatgccccttacgtcctgggctacacacgtactacaatgctgtggacaaagggcagcaagcgggcaaccgcaagcaaatcccagaaaccacggctcagttcagatcgcaggctgcaactcgcctgcgtgaaggtggaatcgctagtaattgcaggtcagcatactgcagtgaattcgttcccgggccttgtacacaccgcccgtcacaccatggaagctggtcacgcccgaagtcgttaccctaacttttcggagagggggacgccgaaggtaggactggtgactggggtgaagtcgtaacaaggtagccgtaccggaaggtgtggctggatcacctccttttt

SEQ ID NO: 5278 - DNA, 1494 bp, Mastigocoleus testarum
  ref <308>: DATABASE ACCESSION NUMBER: NCBI ACCESSION: NZ_LMTZ01000039.1
  ref <309>: DATABASE ENTRY DATE: 2019-04-01
  ref <313>: RELEVANT RESIDUES IN SEQ ID NO: (1)..(1494)
aaaacggagagtttgatcctggctcaggatgaacgctggcggtatgcttaacacatgcaagtcgaacgaactcttcggagttagtggcggacgggtgagtaacgcgtgagaatctgcctccgggctcgggacaacagttggaaacgactgctaataccggatgtgcctattggtgaaagatttattacctggagatgagctcgcgttggattagctagttggtgtggtaagagcgcaccaaggcgacgatctatagctggtctgagaggacgatcagccacactgggactgagacacggcccagactcctacgggaggcagcagtggggaattttccgcaatgggcgaaagcctgacggagcaataccgcgtgagggaggaaggcttttgggttgtaaacctcttttctcaaggaagaagttctgacggtacttgaggaatcagcatcggctaactccgtgccagcagccgcggtaatacggaggatgcaagcgttatccggaatgattgggcgtaaagcgtccgcaggtggttatgcaagtttactgttaaagagtgaagcttaacttcataagggccgtagaaactgcatgactagagtgcgttcggggcagagggaattcctggtgtagcggtgaaatgcgtagatatcaggaagaacaccggtggcgaaagcgctctgctaggccgcaactgacactgagggacgaaagctaagggagcgaatgggattagataccccagtagtcttagccgtaaacgatggatactaggcgttgcttgtatcgacccgagcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatctggcgaatcttgctgaaaggtgagagtgccttcgggaacgccaagacaggtggtgcatggctgtcgtcagctcgtgtcgtgagatgttgggttaagtcccgcaacgagcgcaaccctcgtttttagttgccagcacttagggtgggcactctagagagactgccggtgacaaaccggaggaaggtggggacgacgtcaagtcatcatgccccttacgttctgggctacacacgtactacaatgctatggacaaagagcagccaactggcgacagtgcgctaatctcataaaccatggctcagttcagattgcaggctgcaactcgcctgcatgaaggaggaatcgctagtaattgcaggtcagcatactgcagtgaattcgttcccgggccttgtacacaccgcccgtcacaccatggaagttggtcacgcccgaagtcgttaccctaaccgttcgcggagggggatgccgaaggtaggactggtgactggggtgaagtcgtaacaaggtagccgtaccggaaggtgtggctggatcacctcctttaaggg

SEQ ID NO: 5279 - DNA, 1541 bp, Mediterraneibacter sp. KCTC 15684
  ref <308>: DATABASE ACCESSION NUMBER: NCBI ACCESSION: NZ_BHGK01000001.1
  ref <309>: DATABASE ENTRY DATE: 2019-04-01
  ref <313>: RELEVANT RESIDUES IN SEQ ID NO: (1)..(1541)
tttatacgagagtttgatcctggctcaggatgaacgctggcggcgtgcttaacacatgcaagtcgaacgaagcacttgatttgattttcttcggagatgaagatcttgtgactgagtggcggacgggtgagtaacgcgtgggcaacctgccttgtacagggggataacagttagaaatgactgctaataccgcataagaccacagcatcacatgatgcaggggtaaaaactgaggtggtacaagatgggcccgcgtctgattagctggttggtgaggtaacggctcaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaacagcaagtctgatgtgaaaacccggggctcaaccccgggactgcattggaaactgttgatctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgcccttgacatccgaatgaccggtgagtaatgtcgcctttccttcgggacattcgagacaggtggtgcatggttgtcgtcagctcgtgtcgtgagatgttgggttaagtcccgcaacgagcgcaacccttatctttagtagccagcaattaggatgggcactctagagagactgccagggataacctggaggaaggtggggatgacgtcaaatcatcatgccccttatgggcagggctacacacgtgctacaatggcgtaaacaaagggaagcagagtcgtgaggccgagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttctaagga

SEQ ID NO: 5280 - DNA, 1562 bp, Megamonas funiformis
  ref <308>: DATABASE ACCESSION NUMBER: NCBI ACCESSION: NZ_LT669948.1
  ref <309>: DATABASE ENTRY DATE: 2019-04-01
  ref <313>: RELEVANT RESIDUES IN SEQ ID NO: (1)..(1562)
tttttggagagtttgatcctggctcaggacgaacgctggcggcgtgcttaacacatgcaagtcgaacggggtgtttatttcggtaaacaccaagtggcgaacgggtgagtaacgcgtaagcaatctaccttcaagatggggacaacacttcgaaaggggtgctaataccgaatgaatgtaagagtatcgcatgagacacttactaaaggaggcctctgacataagcttccgcttgaagatgagcttgcgtctgattagctagttggtgagggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgaacgatgaaggtcttaggatcgtaaagttctgttgttagggacgaagggtaagaatcataataaggtttttatttgacggtacctaacgaggaagccacggctaactacgtgccagcagccgcggtaatacgtaggcggcaagcgttgtccggaattattgggcgtaaagggagcgcaggcgggaaactaagcggatcttaaaagtgcggggctcaaccccgtgatggggtccgaactggttttcttgagtgcaggagaggaaagcggaattcccagtgtagcggtgaaatgcgtagatattgggaagaacaccagtggcgaaggcggctttctggactgtaactgacgctgaggctcgaaagctagggtagcgaacgggattagataccccggtagtcctagccgtaaacgatggatactaggtgtgggaggtatcgaccccttccgtgccggagttaacgcaataagtatcccgcctggggagtacggccgcaaggttgaaactcaaaggaattgacgggggcccgcacaagcggtggagtatgtggtttaattcgacgcaacgcgaagaaccttaccaagacttgacattgattgaaagacttagagataagtcccttctcttcggagaacaagaaaacaggtggtgcatggctgtcgtcagctcgtgtcgtgagatgttgggttaagtcccgcaacgagcgcaacccctatactatgttgccagcattacggatgggaactcatagtagactgccgcggacaacgcggaggaaggcggggatgacgtcaagtcatcatgccccttacgtcttgggctacacacgtactacaatgggatgaacagagggaagcgaaatcgcgaggtggagcggatccctaaaagcatctctcagttcggattgtaggctgaaactcgcctacatgaagtcggaatcgctagtaatcgcaggtcagcatactgcggtgaatacgttcccgggccttgtacacaccgcccgtcacaccacgaaagtcattcacacccgaagccggctaagggcctatggtaccgaccgtctaaggtgggggcgatgattggggtgaagtcgtaacaaggtagccgtatcggaaggtgcggctggatcacctcctttctaagga

SEQ ID NO: 5281 - DNA, 1561 bp, Megamonas rupellensis
  ref <308>: DATABASE ACCESSION NUMBER: NCBI ACCESSION: NZ_QRTP01000019.1
  ref <309>: DATABASE ENTRY DATE: 2019-04-01
  ref <313>: RELEVANT RESIDUES IN SEQ ID NO: (1)..(1561)
tttttggagagtttgatcctggctcaggacgaacgctggcggcgtgcttaacacatgcaagtcgaacggggtgtttatttcggtaaacaccaagtggcgaacgggtgagtaacgcgtaagcaatctaccttcaagatggggacaacacttcgaaaggggtgctaataccgaatgaatgtaagagtatcgcatgagacacttactaaaggaggcctctgaaaatgcttccgcttgaagatgagcttgcgtctgattagctagttggtgagggtaaaggcccaccaaggcgacgatcagtagccggtctgagaggatgaacggccacattgggactgagacacggcccagactcctacgggaggcagcagtggggaatcttccgcaatgggcgaaagcctgacggagcaacgccgcgtgaacgatgaaggtcttaggatcgtaaagttctgttgttagggacgaagggtaagaataataatacggtttttatttgacggtacctaacgaggaagccacggctaactacgtgccagcagccgcggtaatacgtaggcggcaagcgttgtccggaattattgggcgtaaagggagcgcaggcgggaaactaagcggatcttaaaagtgcggggctcaaccccgtgatggggtccgaactggttttcttgagtgcaggagaggaaagcggaattcccagtgtagcggtgaaatgcgtagatattgggaagaacaccagtggcgaaggcggctttctggactgtaactgacgctgaggctcgaaagctagggtagcgaacgggattagataccccggtagtcctagccgtaaacgatggatactaggtgtgggaggtatcgaccccttccgtgccggagttaacgcaataagtatcccgcctggggagtacggccgcaaggttgaaactcaaaggaattgacgggggcccgcacaagcggtggagtatgtggtttaattcgacgcaacgcgaagaaccttaccaagacttgacattgattgaaagacctagagataggtcccttctcttcggagaacaagaaaacaggtggtgcatggctgtcgtcagctcgtgtcgtgagatgttgggttaagtcccgcaacgagcgcaacccctatactatgttgccagcattacggatgggaactcatagtagactgccgcggacaacgcggaggaaggcggggatgacgtcaagtcatcatgccccttacgtcttgggctacacacgtactacaatgggatgaacagagggaagcgaaatcgcgaggtggagcggatccctaaaagcatctctcagttcggattgtaggctgaaactcgcctacatgaagtcggaatcgctagtaatcgcaggtcagcatactgcggtgaatacgttcccgggccttgtacacaccgcccgtcacaccacgaaagtcattcacacccgaagccggctaagggcctatggtaccgaccgtctaaggtgggggcgatgattggggtgaagtcgtaacaaggtagccgtatcggaaggtgcggctggatcacctcctttctaagga

SEQ ID NO: 5282 - DNA, 1571 bp, Megasphaera cerevisiae
  ref <308>: DATABASE ACCESSION NUMBER: NCBI ACCESSION: NZ_FUXD01000110.1
  ref <309>: DATABASE ENTRY DATE: 2019-04-01
  ref <313>: RELEVANT RESIDUES IN SEQ ID NO: (1)..(1571)
tatcatggagagtttgatcctggctcaggacgaacgctggcggcgtgcttaacacatgcaagtcgaacgagaggacaagagaagcttgcttcttttggaatcgagtggcaaacgggtgagtaacgcgtaaacaacctgccctccggatggggacaacagctggaaacggctgctaataccgaatacgatctaaaggccgcatgacctttagaagaaaagatggccactgaatatgctatcgccggaagaggggtttgcgtctgattagctagttggaggggtaacggcccaccaaggcaatgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttatatgggacgaacgggtgtatggtcaatacccatacgccgtgacggtaccgtaagagaaagccacggctaactacgtgccagcagccgcggtaatacgtaggtggcaagcgttgtccggaatcattgggcgtaaagggcgcgcaggcggttcggtaagtcggtcttaaaagtgcggggcttaaccccgtgatgggattgaaactgccggactggagtgtcggagaggaaagcagaattcctagtgtagcggtgaaatgcgtagatattaggaggaataccagtggcgaaagcggctttctggacgacaactgacgctgaggcgcgaaagccaggggagcaaacgggattagataccccggtagtcctggccgtaaacgatggatactaggtgtaggaggtatcgaccccttctgtgccggagttaacgcaataagtatcccgcctggggagtacggccgcaaggttgaaactcaaaggaattgacgggggcccgcacaagcggtggagtatgtggtttaattcgacgcaacgcgaagaaccttaccaagccttgacattgagtgccagggatagagatatcctgttcttcttcggaagacgcgaaaacaggtggtgcacggctgtcgtcagctcgtgtcgtgagatgttgggttaagtcccgcaacgagcgcaacccctatcttctgttgccagcacgtaaaggtgggaactcagaagagactgccgcagacaatgcggaggaaggcggggatgacgtcaagtcatcatgccccttatggcttgggctacacacgtactacaatggctcttaatagagggaagcaaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttcta

SEQ ID NO: 5283 - DNA, 295 bp, Megasphaera elsdenii
  ref <308>: DATABASE ACCESSION NUMBER: NCBI ACCESSION: NZ_FRAK01000004.1
  ref <309>: DATABASE ENTRY DATE: 2019-04-01
  ref <313>: RELEVANT RESIDUES IN SEQ ID NO: (1)..(295)
tatcatggagagtttgatcctggctcaggacgaacgctggcggcgtgcttaacacatgcaagtcgaacgagaagagatgagaagcttgcttcttatcaattcgagtggcaaacgggtgagtaacgcgtaagcaacctgcccttcagatggggacaacagctggaaacggctgctaataccgaatacgttctttttgtcgcatggcagagggaagaaagggaggctcttcggagctttcgctgaaggaggggcttgcgtctgattagctagttggaggggtaacggcccaccaagg

SEQ ID NO: 5284 - DNA, 1573 bp, Megasphaera genomosp. type 1
  ref <308>: DATABASE ACCESSION NUMBER: NCBI ACCESSION: NZ_ADGP01000010.1
  ref <309>: DATABASE ENTRY DATE: 2019-04-01
  ref <313>: RELEVANT RESIDUES IN SEQ ID NO: (1)..(1573)
tatcatggagagtttgatcctggctcaggacgaacgctggcggcgtgcttaacacatgcaagtcgaacgagaggacatgggaagcttgcttcctatgaaatcgagtggcaaacgggtgagtaacgcgtaaacaacctgcccttcggatggggataacagccggaaacggctgctaataccgaatacgatcttttcgtcgcatgacggaaagaagaaaggatggcctctatacaaagctatcgccgaaggaggggtttgcgtctgattagctggttggaggggtaacggcccaacaaggcgatgatcagtagccggtctgagaggatgaacggccacattgggactgagacacggcccagactcctacgggaggcagcagtggggaatcttccgcaatggacgaaagtctgacggagcaacgccgcgtgagtgaagaaggtcttcggattgtaaaagctctgttatacgggacgaaaaagacggatgccaacagtatccgtccgtgacggtaccgtaagagaaagccacggctaactacgtgccagcagccgcggtaatacgtaggtggcaagcgttgtccggaattattgggcgtaaagggcgcgcaggcggttcggtaagtctgtcttaaaagtgcggggcttaaccccgtgaggggacggaaactgtcgaacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacaggattagataccctggtagtccacgccgtaaacgatggatactaggtgtaggaggtatcgaccccttctgtgccgtagttaacgctataagtatcccgcctggggagtacggccgcaaggttgaaactcaaaggaattgacgggggcccgcacaagcggtggagtatgtggtttaattcgacgcaacgcgaagaaccttaccaagccttgacattgatcgcaattttcagagatgagaagttcctcttcggaggacgagaaaacaggtggtgcacggctgtcgtcagctcgtgtcgtgagatgttgggttaagtcccgcaacgagcgcaacccctatcttctgttaccagcacgtaagggtggggactcaggagagactgccgcagacaatgcggaggaaggcggggatgacgtcaagtcatcatgccccttatggcttgggctacacacgtactacaatggctctaaatagagggaagcgaaggagcgatccggagcaaaacccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttcta

SEQ ID NO: 5285 - DNA, 1300 bp, Megasphaera genomosp. type 2
  ref <308>: DATABASE ACCESSION NUMBER: NCBI ACCESSION: NZ_NFMF01000009.1
  ref <309>: DATABASE ENTRY DATE: 2019-04-01
  ref <313>: RELEVANT RESIDUES IN SEQ ID NO: (1)..(1300)
atggagagtttgatcctggctcaggacgaacgctggcggcgtgcttaacacatgcaagtcgaacgagaggatatggaaagcttgctttctataaaatctagtggcaaacgggtgagtaacgcgtaaacaacctgcccttcggatggggacaacagctggaaacggctgctaataccgaatacgttcttttcatcgcatggtgagaagaagaaaggacggcctctacacaaagcggtcgccgaaggaggggtttgcgtctgattagctagttggaggggtaacggcccaacaaggcgacgatcagtagccggtctgagaggatgaacggccacattgggactgagacacggcccagactcctacgggaggcagcagtggggaatcttccgcaatggacgaaagtctgacggagcaacgccgcgtgagtgaagacggtcttcggattgtaaagctctgttatacgggacgaacggcaaggtggtaaatagccatcatgagtgacggtaccgtaagagaaagccacggctaactacgtgccagcagccgcggtaatacgtaggtggcaagcgttgtccggaattattgggcgtaaagggcgcgcaggcggttttttaagtcggtcttaaaagtgcggggcttaaccccgtgaggggaccgaaactggaagacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacaggattagataccctggtagtccacgccgtaaacgatggatactaggtgtaggaggtatcgactccttctgtgccgtagttaacgctataagtatcccgcctggggagtacggccgcaaggttgaaactcaaaggaattgacgggggcccgcacaagcggtggagtatgtggtttaattcgacgcaacgcgaagaaccttaccaagccttgacattgatcgcaattttcagagatgagaagttcctcttcggaggacgagaaaacaggtggtgcacggctgtcgtcagctcgtgtcgtgagatgttgggttaagtcccgcaacgagcgcaacccctatcttctgttaccagcacgtaakggtggggactcaggagagactgccgcagacaatgcggaggaaggcggggatgacgtcaagtcatcatgccccttatggcttgggctacacacgtactacaatggctcttaatagagggaagcgaaggagtgatctggagc

SEQ ID NO: 5286 - DNA, 1570 bp, Megasphaera hexanoica
  ref <308>: DATABASE ACCESSION NUMBER: NCBI ACCESSION: NZ_CP011940.1
  ref <309>: DATABASE ENTRY DATE: 2019-04-01
  ref <313>: RELEVANT RESIDUES IN SEQ ID NO: (1)..(1570)
atggagagtttgatcctggctcaggacgaacgctggcggcgtgcttaacacatgcaagtcgaacgagaggacatgaaaagcttgctttttatggaatcgagtggcaaacgggtgagtaacgcgtaagcaacctgccctgcagatggggacaacagctggaaacggctgctaataccgaatacgaagcagctcccgcatgggggcagcttgaaaggatggcctctgaatatgctatcgctgcaggaggggcttgcgtctgattagctggttggaggggtaacggcccaccaaggtcgacgatcagtagccggtctgagaggatgaacggccacgattgggactgagacacggcccagactcctacgggaggcagcaggtggggaatcttccgcaatggacgaaagtctgacggagcaacgccgcgtgagtgaagacggccttcgggttgtaaagctctgttatacgggacgaacgggcgggatgctaataccatcctgttgtgacggtaccgtaagagaaagccacggctaactacgtgccagcagccgcggtaatacgtaggtggcaagcgttgtccggaattattgggcgtaaagggtgcgcaggcggtctcttaagtctgtcttaaaagtgcggggctcaaccccgtgaggggacggaaactgggagactggagtatcggagaggaaagcagaattcctagtgtagcggtgaaatgcgtagatattaggaggaataccagtggcgaaagcggctttctggacgacaactgacgctgaggcacgaaagccaggggagcgaacgggattagataccccggtagtcctggccgtaaacgatgggtactaggtgtaggaggtatcgaccccttctgtgccggagttaacgcaataagtaccccgcctggggagtacggccgcaaggctgaaactcaaaggaattgacgggggcccgcacaagcggtggagtatgtggtttaattcgacgcaacgcgaagaaccttaccaagccttgacattgatcgcaatggatagagatatccagttcctcttcggaggacgagaaaacaggtggtgcacggctgtcgtcagctcgtgtcgtgagatgttgggttaagtcccgcaacgagcgcaacccctatcttctgttaccagcacgtgatggtggggactcaggagagactgccgcagacaatgcggaggaaggcggggatgacgtcaagtcatcatgccccttatggcttgggctacacacgtactacaatggctcttaatagagggaagcgaaagggcgacctggagcaaaccccaaaaacagagtcccagttcggattgcaggctgcaacccgcctgcatgaaggaggaatcgctagtaatcgcaggtcagcatactgcggtgaatacgttcccgggccttgtacacaccgcccgtcacaccacgaaagtcattcacacccgaagccggtgaggcaaccgcaaggaaccagccgtcgaaggtgggggcgatgattggggtgaagtcgtaacaaggtagccgtatcggaaggtgcggctggatcacctcctttcta

SEQ ID NO: 5287 - DNA, 1556 bp, Megasphaera massiliensis
  ref <308>: DATABASE ACCESSION NUMBER: NCBI ACCESSION: NZ_HF954548.1
  ref <309>: DATABASE ENTRY DATE: 2019-04-01
  ref <313>: RELEVANT RESIDUES IN SEQ ID NO: (1)..(1556)
tggagagtttgatcctggctcaggacgaacgctggcggcgtgcctaatacatgcaagtcgagcggacttgatgaagtgcttgcacttctgatggttagcggcggacgggtgagtaacacgtgggtaacctgcccataagactgggataacattcggaaacgaatgctaataccggatacgcggtttggtcgcatggccgaaccgggaaagacggagcaatctgtcacttatggatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgctatggagagtaactgctccataggtgacggtacctgagaagaaagccccggctaactacgtgccagcagccgcggtaatacgtagggggcaagcgttgtccggaattattgggcgtaaagcgcgcgcaggcggccttgtaagtctgtcgtttaaactcggagctcaacttcgagtcgcgatggaaactgcaaagcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccctttgaccgtcctagagatagggctttccttcgggacaaaggagacaggtggtgcatggttgtcgtcagctcgtgtcgtgagatgttgggttaagtcccgcaacgagcgcaacccttgatcttagttgccagcacttcgggtgggcactctaggatgactgccggtgacaaaccggaggaaggtggggatgacgtcaaatcatcatgccccttatgacctgggctacacacgtactacaatggccgatacaacgggaagcgaaaccgcgaggtggagccaatcctatcaaagtcggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaagga

SEQ ID NO: 5288 - DNA, 1555 bp, Megasphaera micronuciformis
  ref <308>: DATABASE ACCESSION NUMBER: NCBI ACCESSION: NZ_GL538193.1
  ref <309>: DATABASE ENTRY DATE: 2019-04-01
  ref <313>: RELEVANT RESIDUES IN SEQ ID NO: (1)..(1555)
atggagagtttgatcctggctcaggacgaacgctggcggcgtgcttaacacatgcaagtcgaacgagagcgtagagaaagcttgctttttctacaatctagtggcaaacgggtgagtaacgcgtaaacaacctgccctacggatggggacaacagctggaaacggctgctaataccgaatacgttccgaaagtcgcatgactgtcggaagaaaggatggcctctatttataagctatcgccggaggaggggtttgcgtctgattagctagttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaagctctgttatacgggacgaataatcttgtggttaatacccataagaagtgacggtaccgtaagagaaagccacggctaactacgtgccagcagccgcggtaatacgtaggtggcaagcgttgtccggaattattgggcgtaaagggcgcgcaggcggcttcttaagtctgtcttaaaagtgcggggcttaaccccgtgatgggatggaaactgggaagctcagagtatcggagaggaaagcggaattcctagtgtagcggtgaaatgcgtagatattaggaggaacaccagtggcgaaagcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattgatcgcaaggagtagagatactctgttcttcttcggaagacgagaaaacaggtggtgcacggctgtcgtcagctcgtgtcgtgagatgttgggttaagtcccgcaacgagcgcaacccctatcttctgttaccagcacgtaacggtggggactcaggagagactgccgcagacaatgcggaggaaggcggggatgacgtcaagtcatcatgccccttatggcttgggctacacacgtactacaatggctcttaatagagggaggcgaaggagcgatccggagcaaaccccaaaaacagagtctcagttcggattgtaggctgcaactcgcctacatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctgg

SEQ ID NO: 5289 - DNA, 1570 bp, Megasphaera sp. AM44-1BH
  ref <308>: DATABASE ACCESSION NUMBER: NCBI ACCESSION: NZ_QSFA01000005.1
  ref <309>: DATABASE ENTRY DATE: 2019-04-01
  ref <313>: RELEVANT RESIDUES IN SEQ ID NO: (1)..(1570)
atcatggagagtttgatcctggctcaggacgaacgctggcggcgtgcttaacacatgcaagtcgaacgagaggacatgaaaagcttgctttttatggaatcgagtggcaaacgggtgagtaacgcgtaagcaacctgccctgcagatggggacaacagctggaaacggctgctaataccgaatacgaagcagctcccgcatgggggcagcttgaaaggatggcctctgaatatgctatcgctgcaggaggggcttgcgtctgattagctggttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgagtgaagacggccttcgggttgtaaagctctgttatacgggacgaacgggcgaggggctaataccctcttgtcgtgacggtaccgtaagagaaagccacggctaactacgtgccagcagccgcggtaatacgtaggtggcaagcgttgtccggaattattgggcgtaaagggtgcgcaggcggtctcttaagtctgtcttaaaagtgcggggcttaaccccgtgaggggacggaaactgggagactggagtatcggagaggaaagcagaattcctagtgtagcggtgaaatgcgtagatattaggaggaataccagtggcgaaagcggctttctggacgacaactgacgctgaggcacgaaagccaggggagcgaacgggattagataccccggtagtcctggccgtaaacgatgggtactaggtgtaggaggtatcgaccccttctgtgccggagttaacgcaataagtaccccgcctggggagtacggccgcaaggctgaaactcaaaggaattgacgggggcccgcacaagcggtggagtatgtggtttaattcgacgcaacgcgaagaaccttaccaagccttgacattgatcgcaacgggtagagatacccggttcctcttcggaggacgagaaaacaggtggtgcacggctgtcgtcagctcgtgtcgtgagatgttgggttaagtcccgcaacgagcgcaacccctatcttctgttaccagcgagttaagtcggggactcaggagagactgccgcagacaatgcggaggaaggcggggatgacgtcaagtcatcatgccccttatggcttgggctacacacgtactacaatggctcttaatagagggaagcgaaagggcgacctggagcaaaccccaaaaacagagtcccagttcggattgcaggctgcaacccgcctgcatgaaggaggaatcgctagtaatcgcaggtcagcatactgcggtgaatacgttcccgggccttgtacacaccgcccgtcacaccacgaaagtcattcacacccgaagccggtgaggcaaccgcaaggaaccagccgtcgaaggtgggggcgatgattggggtgaagtcgtaacaaggtagccgtatcggaaggtgcggctggatcacctcctttcta

SEQ ID NO: 5290 - DNA, 1565 bp, Megasphaera sp. BL7
  ref <308>: DATABASE ACCESSION NUMBER: NCBI ACCESSION: NZ_APHX01000179.1
  ref <309>: DATABASE ENTRY DATE: 2019-04-01
  ref <313>: RELEVANT RESIDUES IN SEQ ID NO: (1)..(1565)
atggagagtttgatcctggctcaggacgaacgctggcggcgtgcttaacacatgcaagtcgaacgagaagagatgagaagcttgcttcttattgattcgagtggcaaacgggtgagtaacgcgtaagcaacctgccctctagatggggacaacagctggaaacggctgctaataccgaatacgttctttctgtcgcatggcagaaggaagaaagggaggctcttcggagctttcgctggaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatacgggacgaatggtacgacggtcaatacccgtcgtaagtgacggtaccgtaagagaaagccacggctaactacgtgccagcagccgcggtaatacgtaggtggcaagcgttgtccggaattattgggcgtaaagggcgcgcaggcggcgtcgtaagtcggtcttaaaagtgcggggcttaaccccgtgaggggaccgaaactgcgatgctagagtatcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgatggatactaggtgtaggaggtatcgaccccttctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgattgctaagggtagagataccctgttcctcttcggaggacaagaaaacaggtggtgcacggctgtcgtcagctcgtgtcgtgagatgttgggttaagtcccgcaacgagcgcaacccctatcttctgttaccagcgagttaagtcggggactcaggagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaacccgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctccgttcta

SEQ ID NO: 5291 - DNA, 1574 bp, Megasphaera sp. BV3C16-1
  ref <308>: DATABASE ACCESSION NUMBER: NCBI ACCESSION: NZ_AWXA01000023.1
  ref <309>: DATABASE ENTRY DATE: 2019-04-01
  ref <313>: RELEVANT RESIDUES IN SEQ ID NO: (1)..(1574)
atggagagtttgatcctggctcaggacgaacgctggcggcgtgcttaacacatgcaagtcgaacgagagatgaaaagaagcttgcttcttttgagatcgagtggcaaacgggtgagtaacgcgtaaacaacctgccctacggatggggacaacagttggaaacgactgctaataccgaatacgctcatagagccgcatgactttatgaggaaaggatggcctctatattatgctatcgccggaggaggggtttgcgtctgattagctagttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaaactctgttatacgggacgaatgtaggcatggttaatacccatgcgtagtgacggtaccgtaagagaaagccacggctaactacgtgccagcagccgcggtaatacgtaggtggcaagcgttgtccggaattattgggcgtaaagggcgcgcaggcggttcagtcagtctgtcttaaaagtgcggggcttaaccccgtgaggggacggaaactgctgaactggagtatcggagaggaaagcagaattcctagtgtagcggtgaaatgcgtagatattaggaggaataccagtggcgaaagcggctttctggacgaacactgacgctgaggcgcgaaagccaggggagcgaacgggattagataccccggtagtcctggccgtaaacgatggatactaggtgtaggaggtatcgaccccttctgtgccggagttaacgcaataagtatcccgcctggggagtacgaccgcaaggttgaaactcaaaggaattgacgggggcccgcacaagcggtggagtatgtggtttaattcgacgcaacgcgaagaaccttaccaagccttgacattgattgaccggcatagagatatgcctttcttcttcggaagacaagaaaacaggtggtgcacggctgtcgtcagctcgtgtcgtgagatgttgggttaagtcccgcaacgagcgcaacccctatcttctgttaccagcgagtagcgtcggggactcaggagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttctagggaga

SEQ ID NO: 5292 - DNA, 1356 bp, Megasphaera sp. DISK 18
  ref <308>: DATABASE ACCESSION NUMBER: NCBI ACCESSION: NZ_LUGJ01000022.1
  ref <309>: DATABASE ENTRY DATE: 2019-04-01
  ref <313>: RELEVANT RESIDUES IN SEQ ID NO: (1)..(1356)
gaagaaagggaggccttcgggctttcgctggaggaggggcttgcgtctgattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacggccttcgggttgtaaagttctgttatatgggacgaacaggacatcggttaatacccggtgtctttgacggtaccgtaagagaaagccacggctaactacgtgccagcagccgcggtaatacgtaggtggcaagcgttgtccggaattattgggcgtaaagggcgcgcaggcggcatcgcaagtcggtcttaaaagtgcggggcttaaccccgtgaggggaccgaaactgtgaagctcgagtgtcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgatggatactaggtgtaggaggtatcgactccttctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgattgctacggaaagagatttccggttcttcttcggaagacaagaaaacaggtggtgcacggctgtcgtcagctcgtgtcgtgagatgttgggttaagtcccgcaacgagcgcaacccctatcttctgttgccagcacctcgggtggggactcagaagagactgccgcagacaatgcggaggaaggcggggatgacgtcaagtcatcatgccccttatggcttgggctacacacgtactacaatggctcttaatagagggaggcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggcaaccgcaaggaaccagccgtcgaaggtgggggcgatgattggggtgaagtcgtaacaaggtagccgtatcggaaggtgcggctggatcacctcctttcta

SEQ ID NO: 5293 - DNA, 1571 bp, Megasphaera sp. DJF B143; identical to SEQ ID NO: 2350
  ref <308>: DATABASE ACCESSION NUMBER: NCBI ACCESSION: NZ_LODR01000015.1
  ref <309>: DATABASE ENTRY DATE: 2019-04-01
  ref <313>: RELEVANT RESIDUES IN SEQ ID NO: (1)..(1571)

SEQ ID NO: 5294 - DNA, 1089 bp, Megasphaera sp. MJR8396C
  ref <308>: DATABASE ACCESSION NUMBER: NCBI ACCESSION: NZ_KQ958178.1
  ref <309>: DATABASE ENTRY DATE: 2019-04-01
  ref <313>: RELEVANT RESIDUES IN SEQ ID NO: (1)..(1089)
cggtcaatacccgttatccctgacggtaccgtaagagaaagccacggctaactacgtgccagcagccgcggtaatacgtaggtggcaagcgttgtccggaattattgggcgtaaagggcgcgcaggcggcatcgcaagtcggtcttaaaagtgcggggcttaaccccgtgaggggaccgaaactgtgaagctcgagtgtcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgatggatactaggtgtaggaggtatcgactccttctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgattgctacggaaagagatttccggttcttcttcggaagacaagaaaacaggtggtgcacggctgtcgtcagctcgtgtcgtgagatgttgggttaagtcccgcaacgagcgcaacccctatcttctgttgccagcactaagggtggggactcagaagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggcaaccgcaaggaaccagccgtcgaaggtgggggcgatgattggggtgaagtcgtaacaaggtagccgtatcggaaggtgcggctggatcacctcctttcta

SEQ ID NO: 5295 - DNA, 1572 bp, Megasphaera sp. Marseille-P4857
  ref <308>: DATABASE ACCESSION NUMBER: NCBI ACCESSION: NZ_OEQB01000014.1
  ref <309>: DATABASE ENTRY DATE: 2019-04-01
  ref <313>: RELEVANT RESIDUES IN SEQ ID NO: (1)..(1572)
atggagagtttgatcctggctcaggacgaacgctggcggcgtgcttaacacatgcaagtcgaacgagagatgaaaagaagcttgcttcttttgagatcgagtggcaaacgggtgagtaacgcgtaaacaacctgccctacggatggggacaacagttggaaacgactgctaataccgaatacgctcatagagccgcatgactttatgaggaaaggatggcctctacattatgctatcgccggaggaggggtttgcgtctgattagctagttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaaactctgttatacgggacgaatgtaggcatggttaatacccatgcgtagtgacggtaccgtaagagaaagccacggctaactacgtgccagcagccgcggtaatacgtaggtggcaagcgttgtccggaattattgggcgtaaagggcgcgcaggcggttcagtcagtctgtcttaaaagtgcggggcttaaccccgtgaggggacggaaactgctgaactagagtatcggagaggaaagcagaattcctagtgtagcggtgaaatgcgtagatattaggaggaataccagtggcgaaagcggctttctggacgaacactgacgctgaggcgcgaaagccaggggagcgaacgggattagataccccggtagtcctggccgtaaacgatggatactaggtgtaggaggtatcgaccccttctgtgccggagttaacgcaataagtatcccgcctggggagtacgaccgcaaggttgaaactcaaaggaattgacgggggcccgcacaagcggtggagtatgtggtttaattcgacgcaacgcgaagaaccttaccaagccttgacattgattgaccggcatagagatatgcccttcttcttcggaagacaagaaaacaggtggtgcacggctgtcgtcagctcgtgtcgtgagatgttgggttaagtcccgcaacgagcgcaacccctatcttctgttaccagcgagtagtgtcggggactcaggagagactgccgcagacaatgcggaggaaggcggggatgacgtcaagtcatcatgccccttatggcttgggctacacacgtactacaatggctcttaatagagggaagcgaaggagcgatccggagcaaaccccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttctaggga

SEQ ID NO: 5296 - DNA, 1254 bp, Megasphaera sp. NM10
  ref <308>: DATABASE ACCESSION NUMBER: NCBI ACCESSION: NZ_APHY01000126.1
  ref <309>: DATABASE ENTRY DATE: 2019-04-01
  ref <313>: RELEVANT RESIDUES IN SEQ ID NO: (1)..(1254)
ggtcgaacggccacattgggactgagacacggcccagactcctacgggaggcagcagtggggaatcttccgcaatggacgaaagtctgacggagcaacgccgcgtgaacgatgacggccttcgggttgtaaagttctgttatacgggacgaatggtacgacggccaatacccgtcgtaagtgacggtaccgtaagagaaagccacggctaactacgtgccagcagccgcggtaatacgtaggtggcaagcgttgtccggaattattgggcgtaaagggcgcgcaggcggcgtcgtaagtcggtcttaaaagtgcggggcttaaccccgtgaggggaccgaaactgcgatgctagagtatcggagaggaaagcggaattcctagtgtagcggtgaaatgcgtagatattaggaggaacaccagtggcgaaagcggctttctggacgacaactgacgctgaggcgcgaaagccaggggagcaaacgggattagataccccggtagtcctggccgtaaacgatggatactaggtgtaggaggtatcgaccccttctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgattgctaagggtagagataccctgttcctcttcggaggacaagaaaacaggtggtgcacggctgtcgtcagctcgtgtcgtgagatgttgggttaagtcccgcaacgagcgcaacccctatcttctgttaccagcgagttaagtcggggactcaggagagactgccgcagacaatgcggaggaaggcggggatgacgtcaagtcatcatgccccttatggcttgggctacacacgtactacaatggctcttaatagagggaggcgaaggagcgatccggagcaaaccccaaaaacagagtcccagttcggattgcaggctgcaacccgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttctaggga

SEQ ID NO: 5297 - DNA, 1572 bp, Megasphaera sp. UPII 135-E
  ref <308>: DATABASE ACCESSION NUMBER: NCBI ACCESSION: NZ_AFUG01000037.1
  ref <309>: DATABASE ENTRY DATE: 2019-04-01
  ref <313>: RELEVANT RESIDUES IN SEQ ID NO: (1)..(1572)
atggagagtttgatcctggctcaggacgaacgctggcggcgtgcttaacacatgcaagtcgaacgagaggatatggaaagcttgctttctataaaatctagtggcaaacgggtgagtaacgcgtaaacaacctgcccttcggatggggacaacagctggaaacggctgctaataccgaatacgttcttttcatcgcatggtgagaagaagaaaggacggcctctacacaaagcggtcgccgaaggaggggtttgcgtctgattagctagttggaggggtaacggcccaacaaggcgacgatcagtagccggtctgagaggatgaacggccacattgggactgagacacggcccagactcctacgggaggcagcagtggggaatcttccgcaatggacgaaagtctgacggagcaacgccgcgtgagtgaagacggtcttcggattgtaaagctctgttatacgggacgaacggcaaggtggtaaatagccatcatgagtgacggtaccgtaagagaaagccacggctaactacgtgccagcagccgcggtaatacgtaggtggcaagcgttgtccggaattattgggcgtaaagggcgcgcaggcggttttttaagtcggtcttaaaagtgcggggcttaaccccgtgaggggaccgaaactggaagacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacaggattagataccctggtagtccacgccgtaaacgatggatactaggtgtaggaggtatcgactccttctgtgccgtagttaacgctataagtatcccgcctggggagtacggccgcaaggttgaaactcaaaggaattgacgggggcccgcacaagcggtggagtatgtggtttaattcgacgcaacgcgaagaaccttaccaagccttgacattgatcgcaattttcagagatgagaagttcctcttcggaggacgagaaaacaggtggtgcacggctgtcgtcagctcgtgtcgtgagatgttgggttaagtcccgcaacgagcgcaacccctatcttctgttaccagcacgtaatggtggggactcaggagagactgccgcagacaatgcggaggaaggcggggatgacgtcaagtcatcatgccccttatggcttgggctacacacgtactacaatggctcttaatagagggaagcgaaggagtgatctggagcaaaccccaaaaacagagtctcagttcggattgtaggctgcaactcgcctacatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtaggggtgatgattggggtgaagtcgtaacaaggtagccgtatcggaaggtgcggctggatcacctcctttctaggga

SEQ ID NO: 5298 - DNA, 1572 bp, Megasphaera sp. UPII 199-6
  ref <308>: DATABASE ACCESSION NUMBER: NCBI ACCESSION: NZ_AFIJ01000040.1
  ref <309>: DATABASE ENTRY DATE: 2019-04-01
  ref <313>: RELEVANT RESIDUES IN SEQ ID NO: (1)..(1572)
tatcatggagagtttgatcctggctcaggacgaacgctggcggcgtgcttaacacatgcaagtcgaacgagaggacatgggaagcttgcttcctatgaaatcgagtggcaaacgggtgagtaacgcgtaaacaacctgcccttcggatggggataacagccggaaacggctgctaataccgaatacgatcttttcgtcgcatgacggaaagaagaaaggatggcctctatacaaagctatcgccgaaggaggggtttgcgtctgattagctggttggaggggtaacggcccaacaaggcgatgatcagtagccggtctgagaggatgaacggccacattgggactgagacacggcccagactcctacgggaggcagcagtggggaatcttccgcaatggacgaaagtctgacggagcaacgccgcgtgagtgaagaaggtcttcggattgtaaagctctgttatacgggacgaaaaagacggatgccaacagtatccgtccgtgacggtaccgtaagagaaagccacggctaactacgtgccagcagccgcggtaatacgtaggtggcaagcgttgtccggaattattgggcgtaaagggcgcgcaggcggttcggtaagtctgtcttaaaagtgcggggcttaaccccgtgaggggacggaaactgtcgaacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacaggattagataccctggtagtccacgccgtaaacgatggatactaggtgtaggaggtatcgaccccttctgtgccgtagttaacgctataagtatcccgcctggggagtacggccgcaaggttgaaactcaaaggaattgacgggggcccgcacaagcggtggagtatgtggtttaattcgacgcaacgcgaagaaccttaccaagccttgacattgatcgcaattttcagagatgagaagttcctcttcggaggacgagaaaacaggtggtgcacggctgtcgtcagctcgtgtcgtgagatgttgggttaagtcccgcaacgagcgcaacccctatcttctgttaccagcacgtaagggtggggactcaggagagactgccgcagacaatgcggaggaaggcggggatgacgtcaagtcatcatgccccttatggcttgggctacacacgtactacaatggctctaaatagagggaagcgaaggagcgatccggagcaaaacccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttcta

SEQ ID NO: 5299 - DNA, 1566 bp, Megasphaera stantonii
  ref <308>: DATABASE ACCESSION NUMBER: NCBI ACCESSION: NZ_CP029462.1
  ref <309>: DATABASE ENTRY DATE: 2019-04-01
  ref <313>: RELEVANT RESIDUES IN SEQ ID NO: (1)..(1566)
atggagagtttgatcctggctcaggacgaacgctggcggcgtgcttaacacatgcaagtcgaacgggaggacatgggaagcttgcttcctatggactctagtggcaaacgggtgagtaacgcgtaagcaacctgccctccggatggggacaacagctggaaacggctgctaataccgaatacgttttcattgccgcatggcagtgggaagaaaggtggcctctgaatatgctaccgccgggggaggggcttgcgtctgattagctagttggaggggtaacggcccaccaaggcgacgatcagtagccggtctgagaggatgaacggccacattggaactgagacacggtccagactcctacgggaggcagcagtggggaatcttccgcaatgggcgaaagcctgacggagcaacgccgcgtgagcgaagacggccttcgggttgtaaagctctgttatacgggacgaacggctagtgtgccaataccacattagaatgacggtaccgtaagagaaagccacggctaactacgtgccagcagccgcggtaatacgtaggtggcaagcgttgtccggaattattgggcgtaaagggcgcgcaggcggtttcataagtctgtcttaaaagtgcggggcttaaccccgtgaggggacggaaactgtgagactggagtgtcggagaggaaagcggaattcctagtgtagcggtgaaatgcgtagatattaggaggaacaccagtggcgaaagcggctttctggacgacaactgacgctgaggcgcgaaagccaggggagcgaacgggattagataccccggtagtcctggccgtaaacgatggatactaggtgtagggggtatcgacccctcctgtgccggagttaacgcaataagtatcccgcctggggagtacggccgcaaggctgaaactcaaaggaattgacgggggcccgcacaagcggtggagtatgtggtttaattcgacgcaacgcgaagaaccttaccaagccttgacattgagtgctatctccagagatggagagttcttcttcggaagacgcgaaaacaggtggtgcacggctgtcgtcagctcgtgtcgtgagatgttgggttaagtcccgcaacgagcgcaacccctatcttctgttgccagcgcgtcatggcggggactcaggagagactgccgcagacaatgcggaggaaggcggggatgacgtcaagtcatcatgccccttatggcttgggctacacacgtactacaatggctcttaatagagggacgcgaaggagcgatccggagcaaaccccaaaaacagagtcccagttcggattgcaggctgcaacccgcctgcatgaagcaggaatcgctagtaatcgcaggtcagcatactgcggtgaatacgttcccgggccttgtacacaccgcccgtcacaccacgaaagtcattcacacccgaagccggtgaggtaaccttacggagccagccgtcgaaggtgggggcgatgattggggtgaagtcgtaacaaggtagccgtatcggaaggtgcggctggatcacctcctttcta

SEQ ID NO: 5300 - DNA, 1490 bp, Meiothermus cateniformans
  ref <308>: DATABASE ACCESSION NUMBER: NCBI ACCESSION: NZ_QWKX01000156.1
  ref <309>: DATABASE ENTRY DATE: 2019-04-01
  ref <313>: RELEVANT RESIDUES IN SEQ ID NO: (1)..(1490)
ggagagtttgatcctggctcagggtgaacgctggcggtatgcctaagacatgcaagtcggacgggctgttttatgcagccagtggcggacgggtgagtaacacgtaggtgacctaccccaaagtctgggacaactaggagaaatcttagctaatcctggatgtggacactcaccttggtgggtgtctaaagccttcgggcgctttgggatgggcctgcggcgcatcaggtagttggtggggtaatggcctaccaagccgacgacgcgtagctggtctgagaggacgatcagccacaggggtactgagacacggaccccactcctacgggaggcagcagttaggaatcttccgcaatgggcgaaagcctgacggagcgataccgcttgaaggacgaagcccttcggggtgtaaacttctgaactcgggacgataatgacggtaccgaggtaatagcaccggctaactccgtgccagcagccgcggtaatacggagggtgcgagcgttacccggatttactgggtgtaaagggcgtgtaggcggtctctcaagtccgatgctaaagaccggggctcaaccccgggggtgcgttggatactgtgaggctagacggtcggagagggtagcggaatttccggagtagcggtgaaatgcgcagataccggaaggaacgccgatagcgaaagcagctacctggacgatttgtgacgctgaggcgcgaaagcgtggggagcaaaccggattagatacccgggtagtccacgccctaaacgatgagtgctgggtgtccgacatctgttgggtgccgtagctaacgcgttaagcactccacctgggaagtacggccgcaaggctgaaactcaaaggaattgacgggggcccgcacaagcggtggagcatgtggtttaattcgaagcaacgcgcagaaccttaccaggtcttgacatcctgggaaccctggtgaaagccgggggtgcccgcaagggagcccagagacaggtgctgcatggtcgtcgtcagctcgtgtcgtgagatgttgggttaagtcccgcaacgagcgcaacccctgttgctagttgccagcagttcggctgggcactctagcgagactgcctacgaaagtaggaggaaggcggggatgacgtctgatccgcatggcccttacgacctgggcgacacacgtgctacaatgcctgccacaaagcgctgcgacccggtaacgggaagccaatcgcacaaaagcaggctcagttcggattggggtctgcaactcgaccccatgaagccggaatcgctagtaatcgcggatcagccatgccgcggtgaatacgttcccgggccttgtacacaccgcccgtcaagccatgggagtgggttttgcctgaagtcgccgggagccacaggcaggcgcctagggtaaggctcatgactggggctaagtcgtaacaaggtagctgtaccggaaggtgcggctggatcacctcctttcta

SEQ ID NO: 5301 - DNA, 1490 bp, Meiothermus granaticius
  ref <308>: DATABASE ACCESSION NUMBER: NCBI ACCESSION: NZ_QWLB01000091.1
  ref <309>: DATABASE ENTRY DATE: 2019-04-01
  ref <313>: RELEVANT RESIDUES IN SEQ ID NO: (1)..(1490)
atggagagtttgatcctggctcagggtgaacgctggcggtatgcctaagacatgcaagtcgcacggactagttctgctagttagtggcggacgggtgagtaacgcgtaggtgacctgccccaaagtcggggacaaccaggagaaatcctggctaatcctcgatgtgaacctcggtcctgaccgaggttcaaagcttcggcgctttgggatgggcctgcgttggatcaggtagttggtgaggtaatggctcaccaagccgacgacccatagctggtctgagaggacgaccagccacaggggtactgagacacggaccccactcctacgggaggcagcagttaggaatcttccccaatgggcgaaagcctgagggagcgataccgcttgaacgacgaagcccttcggggtgtaaagttctgaagcagggacgataatgacggtacctgcgtaatagcaccggctaactccgtgccagcagccgcggtaatacggagggtgcgagcgttacccggatttactgggtgtaaagggcgtgtaggcggtctctcaagtccgatgctaaagaccgaggctcaacctcgggagtgcgttggatactgtgaggctagacggtcggagagggcagcggaattctcggagtagcggtgaaatgcgcagataccgagaggaacgccaatagcgaaggcagctgcctggacgatttgtgacgctgaggcgcgaaagcgtggggagcaaaccggattagatacccgggtagtccacgccctaaacgttgagtgctgggtgtccggctttagctgggtgccgaagctaacgcgataagcactccacctgggaagtacggtcgcaagactgaaactcaaaggaattgacgggggcccgcacaagcggtggagcatgtggtttaattcgaagcaacgcgaagaaccttaccaggtcttgacatgtagggaaccccggtgaaagccgggggtgcccgcaagggaaccctaacacaggtgctgcatggtcgtcgtcagctcgtgtcgtgagatgttgggttaagtcccgcaacgagcgcaacccttgttgctagttgccatcagctcggctgggcactctagcgagactgcctacgaaagtgggaggaaggcggggatgacgtctgatccgcatggcccttacgacctgggcgacacacgtgctacaatgcccggcacaaagcgccgctacttcgtaagaagatgccaatcgcataaagccgggcttagttcggattgaggtctgcaacccgacctcatgaagctggaatcgctagtaatcgcggatcagccatgccgcggtgaatacgttcccgggccttgtacacaccgcccgtcaagccatgggagtgggttttgcctgaagtcgccgggagctataggcaggcgcctagggtaaggctcatgactggggctaagtcgtaacaaggtaactgtaccggaaggtgcggttggatcacctcctttcta

SEQ ID NO: 5302 - DNA, 1496 bp, Meiothermus hypogaeus
  ref <308>: DATABASE ACCESSION NUMBER: NCBI ACCESSION: NZ_QWKY01000161.1
  ref <309>: DATABASE ENTRY DATE: 2019-04-01
  ref <313>: RELEVANT RESIDUES IN SEQ ID NO: (1)..(1496)
atttttggagagtttgatcctggctcagggtgaacgctggcggtatgcctaagacatgcaagtcgcacggactgtttcggcagttagtggcggacgggtgagtaacacgtaggtgacctgccccaaagtcggggacaactaggagaaatcttagctaatccccgatgtgaacctcggtcctgaccgatgttcaaagcttcggcgctttgggatgggcctgcgctggatcaggtagttggtagggtaatggcctaccaagccgacgacccatagctggtctgagaggacgaccagccacaggggtactgagacacggaccccactcctacgggaggcagcagttaggaatcttccccaatgggcgaaagcctgagggagcgataccgcttgaaggacgaagcccctcggggtgtaaacttctgaactggggacgattatgacggtacccaggtaatagcaccggctaactccgtgccagcagccgcggtaatacggagggtgcgagcgttacccggatttactgggtgtaaagggcgtgtaggcggtctctcaagtccgatgctaaagaccaaggctcaacctcgggaatgcgttggatactgtgaggctagacggtcggagagggtagcggaatttccggagtagcggtgaaatgcgcagataccggaaggaacgccaatagcgaaagcagctacctggacgatttgtgacgctgaggcgcgaaagcgtggggagcaaaccggattagatacccgggtagtccacgccctaaacgttgagtgctgggtgtccgacatctgttgggtgccgtagctaacgcgttaagcactccacctgggaagtacggtcgcaagactgaaactcaaaggaattgacgggggcccgcacaagcggtggagcatgtggtttaattcgaagcaacgcgcagaaccttaccaggtcttgacatgtagggaatctcgctgaaaggcgagcgtgcccgcaagggaaccctaacacaggtgctgcatggtcgtcgtcagctcgtgtcgtgagatgttgggttaagtcccgcaacgagcgcaacccttgttgctagttgctaacggttcggccgagcactctagcgagactgcctacgaaagtaggaggaaggcggggatgacgtctgatccgcatggcccttacgacctgggcgacacacgtgctacaatgccgcgcacaaagcgacgctacttcgcaagaagacgctaatcgcctaaatcgcggctcagttcggattggggtctgcaactcgaccccatgaagctggaatcgctagtaatcgcgaatcagccatgtcgcggtgaatacgttcccgggccttgtacacaccgcccgtcaagccatggaagtgggttttgcctgaaatcgccgggagcctcaggcaggcgcttagggtaaggctcatgactggggctaagtcgtaacaaggtaactgtaccggaaggtgcggttggatcacctcctttctaagg

SEQ ID NO: 5303 - DNA, 1497 bp, Meiothermus luteus
  ref <308>: DATABASE ACCESSION NUMBER: NCBI ACCESSION: NZ_QWKZ01000015.1
  ref <309>: DATABASE ENTRY DATE: 2019-04-01
  ref <313>: RELEVANT RESIDUES IN SEQ ID NO: (1)..(1497)
ttgttggagagtttgatcctggctcagggtgaacgctggcggtatgcctaagacatgcaagtcgaacgggctgtttttgcagccagtggcggacgggtgagtaacacgtaggtgacctaccccaaagtctgggacaaccaggagaaatcctggctaatcccggatgtggacacatcctgtggggtgtgtttaaagctccggcgctttgggatgggcctgcggcgcatcaggtagttggtggggtaatggcccaccaagccgacgacgcgtagctggtctgagaggacggccagccacaggggtactgagacacggaccccactcctacgggaggcagcagttaggaatcttccgcaatgggcgaaagcctgacggagcgataccgcttgaaggaggaagcccttcggggtgtaaacttctgaactggggacgataatgacggtacccaggtaatagcaccggctaactccgtgccagcagccgcggtaatacggagggtgcgagcgttacccggatttactgggtgtaaagggcgtgtaggcggtcttgcaagtccggtgctaaagaccggggctcaaccccgggggtgcgctggatactgtaaggctagacggtcggagggggtagtggaatttccggagtagcggtgaaatgcgcagataccggaaggaacgccgatagcgaaggcagctacctggacgacatgtgacgctgaggcgcgaaagcgtggggagcaaaccggattagatacccgggtagtccacgccctaaacgatgagtgctgggtgtccggcatccgccgggtgccgaagctaacgcgttaagcactccacctggggagtacggccgcaaggttgaaactcaaaggaattgacgggggcccgcacaagcggtggagcatgtggtttaattcgaagcaacgcgaagaaccttaccaggtcttgacatgcagggaaccctggtgaaagctgggggtgcccgcgagggagccctgacacaggtgctgcatggtcgtcgtcagctcgtgtcgtgagatgttgggttaagtcccgcaacgagcgcaacccctgtcgctagttgccagcggtttggccgggcactctagcgagactgcctgcgaaagcaggaggaaggcggggatgacgtctgatccgcatggcccttacgacctgggcgacacacgtgctacaatgcccgccacagagcgctgcgacccggcaacgggaagccaatcgcggaaaagcgggctcagttcggattggggtctgcaactcgaccccatgaagccggaatcgctagtaatcgcggatcagccatgccgcggtgaatacgttcccgggccttgtacacaccgcccgtcaagccatgggagtgggtcttgcctgaagtcgccgggagccacaggcaggcgcctagggtaaggctcatgactggggctaagtcgtaacaaggtagctgtaccggaaggtgcggctggatcacctcctttctaaggag

SEQ ID NO: 5304 - DNA, 1499 bp, Meiothermus roseus
  ref <308>: DATABASE ACCESSION NUMBER: NCBI ACCESSION: NZ_QWLA01000157.1
  ref <309>: DATABASE ENTRY DATE: 2019-04-01
  ref <313>: RELEVANT RESIDUES IN SEQ ID NO: (1)..(1499)
tcactggagagtttgatcctggctcagggtgaacgctggcggtatgcctaagacatgcaagtcgcacggaccggtttcggctggtcagtggcggacgggtgagtaacacgtgggagacgtgccctcaagtgggggaaaaccaggggaaaccctggctaatcccccatgtgaacccccgcttgggcgggtgtttaaagcttcggcgcttgaggatcggcccgcggtgcatcaggtagttggtggggtaatggcccaccaagccgacgacgcatagctggtctgagaggacgaccagccacaggagcactgagacacgggctccactcctacgggaggcagcagttaggaatcttcggcaatgggcgaaagcctgaccgagcgataccgcttgaaggatgaagcccttcggggtgtaaacttctgaactcgggacgatgatgacggtaccgaggtaatagcaccggctaactccgtgccagcagccgcggtaatacggagggtgcgagcgttacccggatttactgggcgtaaagggcgtgtaggcggtctctcaagtccgatgctaaagactggggctcaaccccaggagtgcgttggatactgggaggctagacggtcggagggggtagcggaatttccggagtagcggtgaaatgcgcagataccggaaggaacgccaatagcgaaggcagctacctggacgacttgtgacgctgaggcgcgaaagcgtggggagcaaaccggattagatacccgggtagtccacgccctaaaccatgagtgctgggtgtccggcttctgctgggtgccgtagctaacgcgctaagcactccgcctgggaagtacgcacgcaagtgtgaaactcaaaggaattgacgggggcccgcacaagcggtggagcatgtggtttaattcgaagcaacgcgaagaaccttaccaggccttgacatgcccggaacccctctgaaaggagggggtgcccgcaagggagccgggacacaggtgctgcatggccgtcgtcagctcgtgtcgtgagatgttgggttaagtcccgcaacgagcgcaacccctatccctagttgccagcagttcggctgggcactctatggagactgcctgcgaaagcaggaggaaggcggggatgacgtctggtccgcatggcccttacggcctgggcgacacacgtgctacaatgccaaggacaaagcgctgctacctcgcgagaggacgccaatcgcaaaaaccttggctcagttcggattggagtctgcaactcgactccatgaagccggaatcgctagtaatcgcgaatcagccatgtcgcggtgaatacgttcccgggccttgtacacaccgcccgtcaagccatggaagtgggttctgcctgaagtcgccggtagccttgggcaggcgccgagggccgggctcatgactggggctaagtcgtaacaaggtagctgtaccggaaggtgcggctggatcacctcctttctaaggag

SEQ ID NO: 5305 - DNA, 1497 bp, Meiothermus silvanus
  ref <308>: DATABASE ACCESSION NUMBER: NCBI ACCESSION: NZ_SESJ01000074.1
  ref <309>: DATABASE ENTRY DATE: 2019-04-01
  ref <313>: RELEVANT RESIDUES IN SEQ ID NO: (1)..(1497)
cggagagtttgatcctggctcagggtgaacgctggcggcgtgcctaagacatgcaagtcgaacgggcctgatttcggtcaggctagtggcggacgggtgagtaacacgtgggtgatctaccccaaagtctgggacaactaggggaaaccttagctaatcccggatggtgaggcttctcctgtgaagtctctaaagatttatcgctttgggatgagcccgcggcgcatcagctagttggtggggtaatggcctaccaaggcgacgacgcgtagctggtctgagaggacgaccagccacaggagcactgagacacgggctccactcctacgggaggcagcagttaggaatcttcgtcaatgggcgaaagcctgaacgagcgacgccgcttgagggatgaagcccttcggggtgtaaacctctgaacaggggacgatcatgacggtaccctgctaatagcaccggctaactccgtgccagcagccgcggtaatacggagggtgcgagcgttacccggatttactgggcgtaaagggcgtgtaggcggttttctaagtccggggctaaagaccagggctcaaccctggatgtgccttggatactggaaagctcgacggctggagggggcagcggaatttccggagtagcggtgaaatgcgcagataccggaaggaacgccaatagcgaaggcagctgcctggacagttcgtgacgctgaggcgcgaaagcgtggggagcaaaccggattagatacccgggtagtccacgccctaaacgatgagtgctgggtgtccggctttcgctgggtgccgaagctaacgcgttaagcactccgcctgggaagtacggtcgcaagactgaaactcaaaggaattgacgggggcccgcacaagcggtggagcatgtggtttaattcgaaggaacgcgaagaaccttaccaggccttgacatcctaggaaccctgatgaaagtcgggggtgcccgcaagggaacctagtgacaggtgctgcatggctgtcgtcagctcgtgtcgtgagatgttgggttaagtcccgcaacgagcgcaacccttgtccttagttgctaacgggtaagccgagctctctagggagactgcccgcgaaagcgggaggaaggcggggatgacgtctagtccgcatggcccttacggcctgggcgacacacgtgctacaatgcccggcacaaagcgctgccacatcgcaagatggagcgaatcgcctaaatccgggctcagttcggattggggtctgcaactcgaccccatgaagctggaatcgctagtaatcgcggatcagccatgccgcggtgaatacgttcccgggccttgtacacaccgcccgtcacgccatgggagtgggtttcacctgaagtcgccggtagccacaggcaggcgccgagggtggggctcatgactggggcgaagtcgtaacaaggtaggtgtaccggaaggtgcgcctggatcacctcctttctaaggag

SEQ ID NO: 5306 - DNA, 1494 bp, Meiothermus terrae
  ref <308>: DATABASE ACCESSION NUMBER: NCBI ACCESSION: NZ_QXDL01000407.1
  ref <309>: DATABASE ENTRY DATE: 2019-04-01
  ref <313>: RELEVANT RESIDUES IN SEQ ID NO: (1)..(1494)
ttcttggagagtttgatcctggctcagggtgaacgctggcggtatgcctaagacatgcaagtcgcacgggccggtttcggccggccagtggcggacgggtgagtaacacgtgggagacgtgccctcaagcgggggaaaaccgggggaaaccccggctaatcccccatgtggacgccggccatggcgggcgtctaaagcctcggcgcttggggatcggcccgcggcgcatcaggtagttggcggggtaacggcccaccaagccgacgacgcgtagctggtctgagaggacggccagccacaggagcactgagacacgggctccactcctacgggaggcagcagttaggaatcttcggcaatgggcgaaagcctgaccgagcgataccgcttgaaggacgaagcccctcggggtgtaaacttctgaactcgggacgatggtgacggtaccgaggtaatagcaccggctaactccgtgccagcagccgcggtaatacggagggtgcgagcgttacccggattcactgggcgtaaagggcgtgtaggcggtccctcaagtccgatgctaaagaccggggctcaaccccgggggtgcgttggatactgtcgggctagacggtcggagggggcagcggaatttccggagtagcggtgaaatgcgcagataccggaaggaacgccgatagcgaaggcagctgcctggacgacctgtgacgctgaggcgcgaaagcgtggggagcaaaccggattagatacccgggtagtccacgccctaaacgatgagtgctgggtgtccggctcctgccgggtgccgtagctaacgcgttaagcactccgcctgggaagtacgcacgcaagtgtgaaactcaaaggaattgacgggggcccgcacaagcggtggagcatgtggtttaattcgaagcgacgcgaagaaccttaccaggccttgacatcccgcgaaccccgccgaaaggggggggtgcccgcgagggagcgcggagacaggtgctgcatggccgtcgtcagctcgtgtcgtgagatgttgggttaagtcccgcaacgagcgcaacccctatccccagttgccagcagtccggctgggcactctggtgagaccgcccgcgaaagcgggaggaaggcggggatgacgtctggtccgcatggccctcacggcctgggcgacacacgtgctacaatggctgcgacagagcgccgccaccccgcgagggggagccaatcgcgcaaacgcagccccagttcggattggagtctgcaactcgactccatgaagccggaatcgctagtaatcgcggatcagccacgccgcggtgaatacgttcccgggccttgtacacaccgcccgtcaagccatggaagtgggttctgcctgaagtcgccggtagccctaggcaggcgccgagggccgggctcatgactggggctaagtcgtaacaaggtagctgtaccggaaggtgcggctggatcacctcctttcta

SEQ ID NO: 5307 - DNA, 1563 bp, Melghirimyces profundicolus
  ref <308>: DATABASE ACCESSION NUMBER: NCBI ACCESSION: NZ_QBKR01000055.1
  ref <309>: DATABASE ENTRY DATE: 2019-04-01
  ref <313>: RELEVANT RESIDUES IN SEQ ID NO: (1)..(1563)
ggagagtttgatcctggctcaggacgaacgctggcggcgtgcctaatacatgcaagtcgagcggaggaagccgacggatcccttcggggtgacgttggtggaatcagcggcggacgggtgagtaacacgtgggcaacctgcccgcaagaccgggataactccgggaaaccggggctaataccggataggacattcccttgcatgagggggtgtggaaaggcggccttttggctgtcacttgcggatgggcccgcggcgcattagcttgttggtgaggtaacggctcaccaaggcgacgatgcgtagccgacctgagagggtgaccggccacactgggactgagacacggcccagactcctgcgggaggcagcagtagggaattttccgcaatgggcgaaagcctgacggagcaacgccgcgtgagtgaggacggccttcgggttgtaaagctctgttctgcgggaagaacgacggccgggtgaagaatccggccgggtgacggtaccgcagaagaaagccccggctaactacgtgccagcagccgcggtaatacgtagggggcaagcgttgtccggaattattgggcgtaaagcgcgcgcaggcggcctgttaagtcgggtgtgaaagaccacggctcaaccgtgggggtgcattcgaaactggcaggcttgagtgcaggagaggagagcggaattcccggtgtagcggtggaatgcgtagagatcgggaggaacaccagtggcgaaggcggctctctggcctgtgactgacgctgaggcgcgaaagcgtggggagcgaacaggattagataccctggtagtccacgccgtaaacgatgagtgctaggtgttgggggtatcacgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccggcgtagagatacgccttcccttcggggcagcggtgacaggtggtgcatggttgtcgtcagctcgtgtcgtgagatgttgggttcagtcccgcaacgagcgcaacccctatcgtcagttgccagcacttcgggtgggcactctggcgagacagccggtgaaagccggaggaaggtggggatgacgtcaaatcatcatgccccttatgtcctgggctacacacgtgctacaatggccggtacaacgggcagcgaacccgcgagggggagccaatcccaaaaaaccggtctcagttcggatcgcaggctgcaactcgcctgcgtgaagctggaatcgctagtaatcgcggatcagcatgccgcggtgaatacgttcccgggccttgtacacaccgcccgtcacaccacgagagtctgcaacacccgaagtcggtgagggaaccctttgggacccagccgccgaaggtggggcagatgattggggtgaagtcgtaacaaggtatccctaccggaaggtggggatggatcacctcctttcta

SEQ ID NO: 5308 - DNA, 1054 bp, Melghirimyces thermohalophilus
  ref <308>: DATABASE ACCESSION NUMBER: NCBI ACCESSION: NZ_FMZA01000035.1
  ref <309>: DATABASE ENTRY DATE: 2019-04-01
  ref <313>: RELEVANT RESIDUES IN SEQ ID NO: (1)..(1054)
acttgcagatgggcccgcggcgcattagctagttggtggggtaatggcctaccaaggcaacgatgcgtagccgacctgagagggtgatcggccacactgggactgagacacggcccagactcctacgggaggcagcagtagggaattttccgcaatgggcgcaagcctgacggagcaacgccgcgtgagtgaggacggccttcgggttgtaaaactctgttctgcgggaagaacggcagccgggtgaacagtccggttgagtgacggtaccgcagaagaaagccccggctaactacgtgccagcagccgcggtaatacgtagggggcaagcgttgtccggaattattgggcgtaaagggcgcgcaggcggcctgttaagtctgatgtgaaagaccgcggctcaaccgcggggtggcatcagaaactggcaggcttgagtgcaggagaggagagtggaattcccggtgtagcggtggaatgcgtagagatcgggaggaacaccagtggcgaaggcggctctctggcctgttactgacgctgaggcgcgaaagcgtggggagcgaacaggattagataccctggtagtccacgccgtaaacgatgagtgctaggtgttgggggtatcacgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgatcggtgtagagatacaccttcccttttgggcagcggtgacaggtggtgcatggttgtcgtcagctcgtgtcgtgagatgttgggttcagtcccgcaacgagcgcaacccttatcgtcagttgccagcacttggggtgggcactctggcgagacagccggtgaaagccggaggaaggtggggatgacgtcaaatcatcatgccccttatgtcctgggctacacacgtgctacaatggccggtacaacgggcagcgaacccgcgagggg

SEQ ID NO: 5309 - DNA, 1551 bp, Melioribacter roseus
  ref <308>: DATABASE ACCESSION NUMBER: NCBI ACCESSION: NC_018178.1
  ref <309>: DATABASE ENTRY DATE: 2019-04-01
  ref <313>: RELEVANT RESIDUES IN SEQ ID NO: (1)..(1551)
tacaacggagagtttgatcctggctcaggacgaacgctggcggcgtgcttaacacatgcaagtctaggggaaattccggcttcggttggaagagtacactggcgcacgggtgagtaatatgtaagtaacctacccataggttcgggataactcgtcgaaagacgggctaataccgaatgatgcagcggacccgcatgggtatgttgttaaagcctatatggtgcctatggatgggcttgcatccgattagctagttggtagggtaacggcctaccaaggcgacgatcggtagctggtctgagaggatgatcagccacactggaactgagacacggtccagactcctacgggaggcagcagtgaggaatattgggcaatgcccgcaagggtgacccagcaacgccgcgtggaggatgacggccgtaaggttgtaaactccttttgagagggacgaaaaattccgatggaatcggaacttgactgtacctctagaaaaagccccggctaactacgtgccagcagccgcggtaatacgtagggggcaagcgttgtccggatttactgggtgtaaagggcgcgtaggcggacctgttagtcagaggtgaaatcctgcggcttaaccgtagaactgcctttgatactgcaggtcttgagttcgaaagagagtagcggaattccaggtgtagtggtgaaatacgtagatatctggaagaacaccagtggcgaaggcggctacttggttcgcaactgacgctgaggcgcgaaagcgtggggagcaaacaggattagataccctggtagtccacgccgtaaacgatgaatactaggtgttggctccgttaggagtcagtgccgcagctaacgcattaagtattccacctggggagtacgatcgcaaggttgaaactcaaaggaattgacgggggcccgcacaagcagtggagcatgtggtttaattcgatgcaacgcgaagaaccttacctaggcttgaaaagcaggcgaccgggtgtgaaagcacccttcccttcggggcgcctgtacaggtgctgcatggctgtcgtcagctcgtgccgtgaggtgttgggttaagtcccgcaacgagcgcaacccctaccattagttgccatcaggttaagctgggcactctaatgggactgcctacgcaagtagtgaggaaggtggggatgacgtcaagtcagcatggcccttacgcctagggctacacacgtgctacaatgggtgctacaacgggtagcgaaaccgcgaggtggagccaatccctaaaaagcatcctcagttcggattggagtctgcaacccgactccatgaagctggaattgctagtaatcgcgcatcagcacggcgcggtgaatacgttcccgggccttgtacacaccgcccgtcaagccatggaagccgggggtacccgaagtcagtgacccaactccgcctcggcggagagggagctgccgaaggtaaaaccggtgactggggctaagtcgtaacaaggtagccgtaccggaaggtgcggctggatcacctcctttctaa

SEQ ID NO: 5310 - DNA, 1556 bp, Melissococcus plutonius
  ref <308>: DATABASE ACCESSION NUMBER: NCBI ACCESSION: NZ_AP018526.1
  ref <309>: DATABASE ENTRY DATE: 2019-04-01
  ref <313>: RELEVANT RESIDUES IN SEQ ID NO: (1)..(1556)
gagagtttgatcctggctcaggacgaacgctggcggcgtgcctaatacatgcaagtcgaacgcttcttctgattaagcttgcttaagaggaaagaagagtggcggacgggtgagtaacacgtgggcaacctgcccatcagaaggggataacatttggaaacaggtgctaataccgtataagactttttttcgcatgaagaggagttaaaaggcgctttcgggtgtcactgatggatgggcccgcggtgcattagctagttggtggggtaaaggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaataggggaaagagtaactgttttcctcgtgacggtatctaaccagaaagccacggctaactacgtgccagcagccgcggtaatacgtaggtggcaagcgttgtccggatttattgggcgtaaagcgagcgcaggcggttttttaagtctgatgtgaaagcccccggctcaaccggggagggtcattggaaactggaagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaacgccttagagataaggtttctccttcgggagcaaagagacaggtggtgcatggctgtcgtcagctcgtgtcgtgagatgttgggttaagtcccgcaacgagcgcaacccttattgttaattgccatcatttagttgggcactctagcgagactgccggtgacaaaccggaggaaggtggggatgacgtcaagtcagcatgccccttatgacctgggctacacacgtgctacaatgggaagtacagagagacgcaagaccgcgaggttaagcaaatctcataaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttagggagccagccgcctaaggtgggacagatgattggggtgaagtcgtaacaaggtagccgtatcggaaggtgcggctggatcacctcctttctaagga

SEQ ID NO: 5311 - DNA, 1564 bp, Melissococcus sp. OM08-11BH
  ref <308>: DATABASE ACCESSION NUMBER: NCBI ACCESSION: NZ_QTZC01000001.1
  ref <309>: DATABASE ENTRY DATE: 2019-04-01
  ref <313>: RELEVANT RESIDUES IN SEQ ID NO: (1)..(1564)
ttattgagagtttgatcctggctcaggacgaacgctggcggcgtgcctaatacatgcaagtcgaacgcacttcttttcaccggagcttgctccaccgaaaagaagtgagtggcggacgggtgagtaacacgtgggcaacctgcccaccagagggggataacacttggaaacaggtgctaataccgcataattgcttttgccgcatggcgaaagtatgaaagacgcttcggtgtcactggtggatgggcccgcggtgcattagttagttggtggggtaacggcctaccaagaccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgatagagtaactgttatcaccttgacggtatctaaccagaaagccacggctaactacgtgccagcagccgcggtaatacgtaggtggcaagcgttgtccggatttattgggcgtaaagcgagcgcaggcggtcttttaagtctgatgtgaaagccctcggctcaaccgaggaaggtcattggaaactggaggacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatggacagtacaatgagttgcgagaccgcgaggtttagctaatctcttaaagctgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccaaagtcggtgaggtaaccttttggagccagccgcctaaggtgggatagatgattggggtgaagtcgtaacaaggtagccgtatcggaaggtgcggctggatcacctcctttctaagga

SEQ ID NO: 5312 - DNA, 1561 bp, Mesoaciditoga lauensis
  ref <308>: DATABASE ACCESSION NUMBER: NCBI ACCESSION: NZ_JQJI01000031.1
  ref <309>: DATABASE ENTRY DATE: 2019-04-01
  ref <313>: RELEVANT RESIDUES IN SEQ ID NO: (1)..(1561)
tggatggagagtttgatcctggctcaggatgaacgctggcggcgtgcctaacacatgcaagtcgaacgacaggtacataactttcatcttcggatgaaagatatgtatgctgagtggcgaacgggtgagtaatacatgggaacgtaccctaaggagggggatagcgttgcgaaagcggcggtaataccccataagcccgagaggggaaaggagcgattgttccgccttaggagcggcccatggcccattagctagttggtgaggtaagagcccaccaaggcgacgatgggtagctggtctgagaggatggtcagccacactgggactgagacacggcccagactcctacgggaggcagcagtggggaatttttcgcaatgggcgcaagcctgacggagcgacgccgcgtggaggaagaagtccttcgggacgtaaactcctgttgtaagggagcaaaaggtacgggagtggaacgtccgtactgagatagtaccttacgaggaagccccggccaactacgtgccagcagccgcggtaacacgtagggggcgagcgttgtccggaatcactgggcgtaaagggtgcgtaggcggcgacttaagtcgagtgtgaaatgtcacggctcaaccgtgtgcagtgcactcgaaactgggttgcttgagttcaagtcaggaaggcggaattgccagtgtaggggtgaaatccgtagatattggcaagaacgccagtggtgaagacggccttctggactgacactgacgctgaggcacgaaagctaggggagcgaacgggattagataccccggtagtcctagccgtaaacgatgttcactaagtgtggggcactgaagtgctccgtgctgcagcaaacgcgataagtgaaccgcctggggagtacggccgcaaggttgaaactcaaaggaattgacgggggcccgcacaagcggtggagcgtgtggtttaattcgacgcaacacgaagaaccttaccaaggcttgacatgtaggtagtagggagccgaaaggcgaccgacccttcggggagcctacacaggtggtgcatggctgtcgtcagctcgtgccgtgaggtgttgggttaagtcccgcaacgagcgcaacccctgtgcttagttgccagcagttcggctgggcactctaagcagaccgccggagaagatccggaggaaggtggggatgacgtcaagtcatcatgccctttatgccttgggcgacacacgcgctacaatggtatggacagaggggagcgaagccgcgaggtggagcgaatcccaaaaaccataccccagtacggattgcaggctgaaacccgcctgcatgaagtcggaatcgctagtaatcgcggatcagccatgccgcggtgaatacgttcccgggccttgtacacaccgcccgtcacaccacccgagtcgggaatgccagaagtcgttcagtccaacccagcaatgggagggcggcgccgaaggcaggctcggtaaggggggtgaagtcgtaacaaggtagctgtaccggaaggtgcggctggatcacctcctttctaagga

SEQ ID NO: 5313 - DNA, 1529 bp, Mesoplasma coleopterae
  ref <308>: DATABASE ACCESSION NUMBER: NCBI ACCESSION: NZ_CP022511.1
  ref <309>: DATABASE ENTRY DATE: 2019-04-01
  ref <313>: RELEVANT RESIDUES IN SEQ ID NO: (1)..(1529)
ttaaaatgagagtttgatcctggctcaggataaacgctggcggcatgcctaatacatgcaagtcgaacggaggtgcttgcacctcagtggcgaacgggtgagtaacacgtatctaatctaccttctagcgggggataacttttggaaacgaaaggtaataccgcatgtggatgttattatcgcatgagaaaacattcaaagatccgtttggatcactagaagatgaggatgcggcgtattagctagtaggcggggtaaaggcccacctaggcgatgatacgtagccgaactgagaggttgatcggccacattgggactgagatacggcccagactcctacgggaggcagcagtagggaatttttcacaatggacgaaagtctgatgaagcaatgccgcgtgagtgatgacggccttcgggttgtaaagctctgttgtaagggaagaaaaaataggagaggaaatgctcttatcttgacggtaccttaccagaaagccacggctaactatgtgccagcagccgcggtaatacataggtggcaagcgttatccggatttattgggcgtatagggtgcgtaggcggtttcgcaagtttgaggttaaagcccggagctcaactccggttcgccttgaaaactgcgggactagaatatcagagaggtaagcggaattccatgtgtagcggtaaaatgcgtagatatatggaagaacaccagtggcgaaagcggcttactggctgattattgacgctgaggcacgaaagcgtggggagcaaataggattagataccctagtagtccacgccgtaaacgttgagtactaagtattggggattacctcagtgctgcagctaacgcattaagtactccgcctgagtagtatgctcgcaagagtgaaactcaaaggaattgacggggacccgcacaagtggtggagcatgtggtttaattcgaagcaacacgaagaaccttaccagggcttgacatacagtgcaaagctacagagatgtagtggaggttaacattgatacaggtggtgcatggttgtcgtcagttcgtgccgtgaggtgttgggttaagtcccgcaacgaacgcaacccttgtcgttagttactaacattaagttgaggactctaacgagactgctagtgtaagctagaggaaggtggggatgacgtcaaatcatcatgccccttatgtcctgggctacacacgtgctacaatggccgatacaaagagtcgcaatctcgcgagggggagctaatctcaaaaagtcggtctcagttcggattgaagtctgcaactcgacttcatgaagccggaatcactagtaatcgcgaatcagctatgtcgcggtgaatacgttctcgggtcttgtacacaccgcccgtcaaaccacgagagttggtaataccagaagtacgtttcctaaccgtaaggaaggcgcgtcccaaggtaggactagcgattggggttaagtcgtaacaaggtatccgtacgggaacgtgcggatggatcacctcctttcta

SEQ ID NO: 5314 - DNA, 1529 bp, Mesoplasma entomophilum
  ref <308>: DATABASE ACCESSION NUMBER: NCBI ACCESSION: NZ_CP022507.1
  ref <309>: DATABASE ENTRY DATE: 2019-04-01
  ref <313>: RELEVANT RESIDUES IN SEQ ID NO: (1)..(1529)
ttaaaatgagagtttgatcctggctcaggataaacgctggcggcatgcctaatacatgcaagtcgaacggaggtgcttgcacctcagtggcgaacgggtgagtaacacgtatctaatctaccttctagcgggggataacttttggaaacgaaaggtaataccgcatgtggatgttattatcgcatgagaaaacattcaaagatccgtttggatcactagaagatgaggatgcggcgtattagctagtaggcggggtaaaggcccacctaggcgatgatacgtagccgaactgagaggttgatcggccacattgggactgagatacggcccagactcctacgggaggcagcagtagggaatttttcacaatggacgaaagtctgatgaagcaatgccgcgtgagtgatgacggccttcgggttgtaaagctctgttgtaagggaagaaaacataggagaggaaatgctcttatcttgacggtaccttaccagaaagccacggctaactatgtgccagcagccgcggtaatacataggtggcaagcgttatccggatttattgggcgtatagggtgcgtaggcggtttcgcaagtttgaggttaaagcccggagctcaactccggttcgccttgaaaactgcgggactagaatatcagagaggtaagcggaattccatgtgtagcggtaaaatgcgtagatatatggaagaacaccagtggcgaaagcggcttactggctgattattgacgctgaggcacgaaagcgtggggagcaaataggattagataccctagtagtccacgccgtaaacgttgagtactaagtattggggattacctcagtgctgcagctaacgcattaagtactccgcctgagtagtatgctcgcaagagtgaaactcaaaggaattgacggggacccgcacaagtggtggagcatgtggtttaattcgaagcaacacgaagaaccttaccagggcttgacatacagtgcaaagctacagagatgtagtggaggttaacattgatacaggtggtgcatggttgtcgtcagttcgtgccgtgaggtgttgggttaagtcccgcaacgaacgcaacccttgtcgttagttactaacattaagttgaggactctaacgagactgctagtgtaagctagaggaaggtggggatgacgtcaaatcatcatgccccttatgtcctgggctacacacgtgctacaatggccgatacaaagagtcgcaatctcgcgagggggagctaatctcaaaaagtcggtctcagttcggattgaagtctgcaactcgacttcatgaagccggaatcactagtaatcgcgaatcagctatgtcgcggtgaatacgttctcgggtcttgtacacaccgcccgtcaaaccacgagagttggtaataccagaagtacgtttcctaaccgtaaggaaggcgcgtcccaaggtaggactagcgattggggttaagtcgtaacaaggtatccgtacgggaacgtgcggatggatcacctcctttcta

SEQ ID NO: 5315 - DNA, 1529 bp, Mesoplasma lactucae
  ref <308>: DATABASE ACCESSION NUMBER: NCBI ACCESSION: NZ_CP024967.1
  ref <309>: DATABASE ENTRY DATE: 2019-04-01
  ref <313>: RELEVANT RESIDUES IN SEQ ID NO: (1)..(1529)
ttcaaatgagagtttgatcctggctcaggataaacgctggcggcatgcctaatacatgcaagtcgaacgggagtgcttgcactccagtggcgaacgggtgagtaacacgtatctaatctaccttttaatgggggataacctttggaaacgaaggataataccgcataagatcttcattatcgcatgagaagaagaggaaagaaccgtttggttcgttaaaagatgaggatgcggcgtattagttagtaggcggggtaatggcccacctagacaatgatacgtagccgaactgagaggttgaacggccacattgggactgagatacggcccagactcctacgggaggcagcagtagggaatttttcacaatggacgaaagtctgatgaagcaatgccgcgtgagtgatgaaggtcttcggattgtaaagctctgttgtaaaggaagaatagacagaagaggaaatgcttttgttttgacggtactttaccagaaagtcacggctaactatgtgccagcagccgcggtaatacataggtgacaagcgttatccggatttattgggcgtacagggtgcgtaggcggttgtgtaagtttgaggttaaagaccggagctcaactccggtttgccttgaaaactatgcaactagaatgtaacagaggtgagtggaattccatgtgtagcggtgaaatgcgtagatatatggaagaacaccagtggcgaaagcggctcaccaggttattattgacgctgaggcacgaaagcgtggggagcaaataggattagataccctagtagtccacgccgtaaacgttgagtactaagtgtcggacttaagttcggtgctgcagctaacgcattaagtactccgcctgagtagtatgcacgcaagtgtgaaactcaaaggaattgacggggacccgcacaagtggtggagcatgtggtttaattcgaagcaacacgaagaaccttaccagggcttgacatccagtgcaatggcatagagatatgccggaggctaacattgagacaggtggtgcatggttgtcgtcagttcgtgccgtgaggtgttgggttaagtcccgcaacgaacgcaacccttgtcattagttactaacattaagttgaggactctaatgagactgctagtgtaagctagaggaaggtggggatgacgtcaaatcatcatgccccttatgtcctgggctacacacgtgctacaatggccgatacaaagagctgcaatcccgtgaggaggagcaaatctcataaagtcggtctcagttcggattgaaggctgcaactcgccttcatgaagccggaatcactagtaatcgcggatcagctatgccgcggtgaatacgttctcgggtcttgtacacaccgcccgtcacaccacgagagttggtaataccagaagtaggttgcctaaccatttggagggcgcctaccaaggtaggactggcgattggggtgaagtcgtaacaaggtatccgtacgggaacgtgcggatggatcacctcctttcta

SEQ ID NO: 5316 - DNA, 1489 bp, Mesorhizobium alhagi
  ref <308>: DATABASE ACCESSION NUMBER: NCBI ACCESSION: NZ_AHAM01000052.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatcactacggaacaactccgggaaactggagctaataccgtatacgtccttcgggagaaagatttatcggtgatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgtttagttaggggtgaaatcccagggctcaaccctggaactgcctctaatactggcaatctagagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgctgtaaacgatggaagccagctgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggatacgagagatcgtatccttcagttcggctggaccggtgacaggtgctgcatggctgtcgtcagctcgtgtcgtgagatgttgggttaagtcccgcaacgagcgcaaccctcgcctttagttgccatcattaagttgggcactctaaagggactgccggtgataagccggaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggcgctgcgctgaccgcaaggaggcaggcgaccacggtagggtcagcgactggggtgaagtcgtaacaaggtagccgtaggggaacctgcggctggatcacctcctttctaagg

SEQ ID NO: 5317 - DNA, 1490 bp, Mesorhizobium amorphae
  ref <308>: DATABASE ACCESSION NUMBER: NCBI ACCESSION: NZ_CP015318.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5318 - DNA, 1491 bp, Mesorhizobium australicum
  ref <308>: DATABASE ACCESSION NUMBER: NCBI ACCESSION: NZ_FXBL01000004.1
  ref <309>: DATABASE ENTRY DATE: 2019-04-01
  ref <313>: RELEVANT RESIDUES IN SEQ ID NO: (1)..(1491)
aacatgagagtttgatcctggctcagaacgaacgctggcggcaggcttaacacatgcaagtcgagcgccccgcaaggggagcggcagacgggtgagtaacgcgtgggaatctacccatccctacggaacaactccgggaaactggagctaataccgtatacgcccttcgggggaaagatttatcggggatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctttcatactggcaatcttgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatgagagctagccgttggcaggtttacctgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgcgctaaccgcaaggaggcaggcgaccacggtagggtcagcgactggggtgaagtcgtaacaaggtagccgtaggggaacctgcggctggatcacctcctttctaagga

SEQ ID NO: 5319 - DNA, 1490 bp, Mesorhizobium ciceri
  ref <308>: DATABASE ACCESSION NUMBER: NCBI ACCESSION: NZ_CP015064.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5320 - DNA, 1489 bp, Mesorhizobium delmotii
  ref <308>: DATABASE ACCESSION NUMBER: NCBI ACCESSION: NZ_FUIG01000092.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtctccagagatggagaccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5321 - DNA, 1574 bp, Mesorhizobium ephedrae
  ref <308>: DATABASE ACCESSION NUMBER: NCBI ACCESSION: NZ_PXYK01000059.1
  ref <309>: DATABASE ENTRY DATE: 2019-04-01
  ref <313>: RELEVANT RESIDUES IN SEQ ID NO: (1)..(1574)
aacatgagagtttgatcctggctcagaacgaacgctggcggcaggcttaacacatgcaagtcgagcgcccctccttcaagcgagcttgaaggggtttttccggatgggagacgaggttttcctgatggaagatttcaagcaagcggagcttgcttgatggaggggagcggcagacgggtgagtaacgcgtgggaatctacctagctctacggaatagctccgggaaactggaattaataccgtatacgtccttcgggagaaagatttatcggagttggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctggagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagccagctgtcggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggcctagagagatctaggtcttcagttcggctggaccggtgacaggtgctgcatggctgtcgtcagctcgtgtcgtgagatgttgggttaagtcccgcaacgagcgcaaccctcgcccctagttgccatcattcagttgggcactctagggggactgccggtgataagccggaggaaggtggggatgacgtcaagtcctcatggcccttacgggctgggctacacacgtgctacaatggtggtgacagtgggcagcgaggccgcgaggccgagctaatctccaaaagccatctcagttcggattgcactctgcaactcgggtgcatgaagttggaatcgctagtaatcgcggatcagcatgccgcggtgaatacgttcccgggccttgtacacaccgcccgtcacaccatgggagttggctttacccgaaggcgctgcgctgaccgcaaggaggcaggcgaccacggtagggtcagtgactggggtgaagtcgtaacaaggtagccgtaggggaacctgcggctggatcacctcctttctaag

SEQ ID NO: 5322 - DNA, 1489 bp, Mesorhizobium erdmanii
  ref <308>: DATABASE ACCESSION NUMBER: NCBI ACCESSION: NZ_MZXX01000021.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5323 - DNA, 2269 bp, Mesorhizobium huakuii
  ref <308>: DATABASE ACCESSION NUMBER: NCBI ACCESSION: NZ_CP006581.1
  ref <309>: DATABASE ENTRY DATE: 2019-04-01
  ref <313>: RELEVANT RESIDUES IN SEQ ID NO: (1)..(2269)
agtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtaaaaactttggtttggtgtgttgacagtttggattggtggcgactatatacgcctcacgaacgagggcggtgcgccgctggcgacgaagaagtttgcttctaagactgccctcagcgaaattcaagagagccgcgtgagcgacactcgaacggccccgaagccacaagcgtaacgggccacgatactgcgtgaagcggtgtctgttctttgaaaattgaataatgaagaaagagaaacgtgggcggcagagtcctgctgaacctcttactccgccaggggtaattggttcgaacgagactttggcggatcacgtttcgtgagaataagtctaccaaggcattaagttgcctaggtgtgaatgttctcgtcgattcatgcgtgaccaaataaagccaaatcaaagtcttctaaacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgcctcggtcctgcccgccaactccctcacgatgccgcgatagcgaaaaggtgtcttgcgcaactggtagcgcatcgccccaagagacgcccacagcacgcccaaaggcaccactatggaggcggtatcgatccagaaacttggggcgacagccacattcgagaacggaagccagatcaagtctacggccccaagccccatgagcaaggccacaatcaggacgagaacccggctcttgtgaaaaatccgtctggaatcgaaccgcgaatatgcattggcgcctagctgggtcacgtcgcgtgcgcgatccggcagtggtcttgcgaaccgctccccacctcccgcctgcccggcttccgatcgactcaacacgaaaaattagcccccgctacattcgaattgtctaaactaatcattaaccacgggagcgggcaagcgcctgggaacgaaccgcgagccattacttacaacatagttaagcaagcggcgccaaaaatatcgtttttatttacccgaggctcctcctcgtccagcctgacggaaccttgcggagcgcaacatatggcgttgtgccggaaactccccgtaaccccctagatataaagggatatgcggtattgctaatatttcatgccgctatataagctagcgctaaattgtgaacgaatggttaagatcacttgaaaaattaatcgaatcaaggtcttgtcaaaattaaaaccgactgaaaccccgcccgatcaggtattcaaacgtaaacaaacacttaatcgcatttgactctgctttttcgtgggacctaggattgaggtgacgggggatgcttgggtatggggttcattcctagctctgtctcgtcgggttcaaacctccaaagggagaaattgacatgaagaagctcatgacgatgacccggcagttccgcgacgacgagaacggcgctgcaatggtcgaatatacagtgctgctcggcatcatcgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5324 - DNA, 1489 bp, Mesorhizobium japonicum; identical to SEQ ID NO: 5322
  ref <308>: DATABASE ACCESSION NUMBER: NCBI ACCESSION: NZ_QKOD01000028.1
  ref <309>: DATABASE ENTRY DATE: 2019-04-01
  ref <313>: RELEVANT RESIDUES IN SEQ ID NO: (1)..(1489)

SEQ ID NO: 5325 - DNA, 1490 bp, Mesorhizobium metallidurans
  ref <308>: DATABASE ACCESSION NUMBER: NCBI ACCESSION: NZ_CAUM01000060.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5326 - DNA, 1490 bp, Mesorhizobium opportunistum
  ref <308>: DATABASE ACCESSION NUMBER: NCBI ACCESSION: NC_015675.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttacggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggaaaccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5327 - DNA, 1490 bp, Mesorhizobium plurifarium
  ref <308>: DATABASE ACCESSION NUMBER: NCBI ACCESSION: NZ_CCND01000051.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctggagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5328 - DNA, 1490 bp, Mesorhizobium prunaredense
  ref <308>: DATABASE ACCESSION NUMBER: NCBI ACCESSION: NZ_FTPD01000032.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtctccagagatggagaccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5329 - DNA, 1489 bp, Mesorhizobium sanjuanii
  ref <308>: DATABASE ACCESSION NUMBER: NCBI ACCESSION: NZ_NWQG01000166.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5330 - DNA, 1490 bp, Mesorhizobium soli
  ref <308>: DATABASE ACCESSION NUMBER: NCBI ACCESSION: NZ_PXYL01000050.1
  ref <309>: DATABASE ENTRY DATE: 2019-04-01
  ref <313>: RELEVANT RESIDUES IN SEQ ID NO: (1)..(1490)
tcaacttgagagtttgatcctggctcagaacgaacgctggcggcaggcttaacacatgcaagtcgagcgccccgcaaggggagcggcagacgggtgagtaacgcgtgggaatctacccagctctacggaataactcagggaaacttgtgctaataccgtatacgtccgagaggagaaagatttatcggagttggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctctgatactgggtgtctagagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagccagctgtcggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggcctagagagatttaggccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccggaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggctttacccgaaggcgctgcgctgaccgcaaggaggcaggcgaccacggtagggtcagtgactggggtgaagtcgtaacaaggtagccgtaggggaacctgcggctggatcacctcctttctaag

SEQ ID NO: 5331 - DNA, 1493 bp, Mesorhizobium sp. 1M-11
  ref <308>: DATABASE ACCESSION NUMBER: NCBI ACCESSION: NZ_LJSD01000075.1
  ref <309>: DATABASE ENTRY DATE: 2019-04-01
  ref <313>: RELEVANT RESIDUES IN SEQ ID NO: (1)..(1493)
ttaaacatgagagtttgatcctggctcagaacgaacgctggcggcaggcttaacacatgcaagtcgagcgccccgcaaggggagcggcagacgggtgagtaacgcgtgggaatctacctatcactacggaacaactccgggaaactggagctaataccgtatacgtccttttggagaaagatttatcggtgatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggatttactgggcgtaaagcgcacgtaggcggattgttaagttaggggtgaaatcccagggctcaaccctggaactgcctttaatactggcaatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgctgtaaacgatggaagctagccgttggcaggtttacctgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggatcccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5332 - DNA, 1490 bp, Mesorhizobium sp. AA22; identical to SEQ ID NO: 5328
  ref <308>: DATABASE ACCESSION NUMBER: NCBI ACCESSION: NZ_LYTO01000050.1
  ref <309>: DATABASE ENTRY DATE: 2019-04-01
  ref <313>: RELEVANT RESIDUES IN SEQ ID NO: (1)..(1490)

SEQ ID NO: 5333 - DNA, 1490 bp, Mesorhizobium sp. AA23
  ref <308>: DATABASE ACCESSION NUMBER: NCBI ACCESSION: NZ_LYTP01000001.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagaaatggataccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5334 - DNA, 1491 bp, Mesorhizobium sp. B2.3
  ref <308>: DATABASE ACCESSION NUMBER: NCBI ACCESSION: NZ_RWKW01000092.1
  ref <309>: DATABASE ENTRY DATE: 2019-04-01
  ref <313>: RELEVANT RESIDUES IN SEQ ID NO: (1)..(1491)
aacatgagagtttgatcctggctcagaacgaacgctggcggcaggcttaacacatgcaagtcgagcgcctcgcaagaggagcggcagacgggtgagtaacgcgtgggaatgtaccctttgctacggaatagctccgggaaactggaattaataccgtatgtgcccttcgggggaaagatttatcggcaaaggatcagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagtgaggggtgaaatcccggggctcaaccccggaactgcctttcatactggcaatcttgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatgagagctagccgttggcaggtttacctgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagagatggtatccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttctaag

SEQ ID NO: 5335 - DNA, 1488 bp, Mesorhizobium sp. DCY119
  ref <308>: DATABASE ACCESSION NUMBER: NCBI ACCESSION: NZ_QYZQ01000001.1
  ref <309>: DATABASE ENTRY DATE: 2019-04-01
  ref <313>: RELEVANT RESIDUES IN SEQ ID NO: (1)..(1488)
aacttgagagtttgatcctggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggatttactgggcgtaaagcgcacgtaggcggatatttaagttaggggtgaaatcccagagctcaactctggaactgcctctaatactgggtatctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgctgtaaacgatggaagccagctgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccgatcgcggatacgagagatcgtatccttcagttaggctggatcggtgacaggtgctgcatggctgtcgtcagctcgtgtcgtgagatgttgggttaagtcccgcaacgagcgcaaccctcgcctttagttgccatcattcagttgggcactctaaagggactgccggtgataagccggaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggcgctgcgctgaccgcaaggaggcaggcgaccacggtagggtcagcgactggggtgaagtcgtaacaaggtagccgtaggggaacctgcggctggatcacctcctttctaag

SEQ ID NO: 5336 - DNA, 1526 bp, Mesorhizobium sp. F7
  ref <308>: DATABASE ACCESSION NUMBER: NCBI ACCESSION: NZ_JTGD01000018.1
  ref <309>: DATABASE ENTRY DATE: 2019-04-01
  ref <313>: RELEVANT RESIDUES IN SEQ ID NO: (1)..(1526)
tttacggagagtttgatcctggctcaggacgaacgctggcggcgtgcttaacacatgcaagtcgaacgatgaagccggagcttgctctggtggattagtggcgaacgggtgagtaacacgtgagtaacctgcccttgactctgggataagcgttggaaacgacgtctaataccggatacgagctaggaccgcatggtcactagctggaaagaacttcggtcaaggatggactcgcggcctatcagctagttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgcaagtgacggtacctgcagaaaaagcaccggctaactacgtgccagcagccgcggtaatacgtagggtgcaagcgttgtccggaattattgggcgtaaagagctcgtaggcggtctgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggaactagatgtagggaccattccacggtttctgtgtcgcagctaacgcattaagttccccgcctggggagtacggtcgcaagactaaaactcaaaggaattgacgggggcccgcacaagcggcggagcatgcggattaattcgatgcaacgcgaagaaccttaccaaggcttgacatatacgagaacgggctagaaatagtcaactctttggacactcgtaaacaggtggtgcatggttgtcgtcagctcgtgtcgtgagatgttgggttaagtcccgcaacgagcgcaaccctcgtcctatgttgccagcacgtaatggtgggaactcatgggagactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtctcagttcggattggggtctgcaactcgaccccatgaagttggagtcgctagtaatcgtgaatcagcaacgtcacggtgaatacgttcccgggccttgtacacaccgcccgtcaagtcatgaaagtcggtaacacccgaagccagtggcccaaccgcaaggagggagctgtcgaaggtgggatcggtgattaggactaagtcgtaacaaggtagccgtaccggaaggtgcggctggatcacctcctttcta

SEQ ID NO: 5337 - DNA, 1490 bp, Mesorhizobium sp. L103C105A0
  ref <308>: DATABASE ACCESSION NUMBER: NCBI ACCESSION: NZ_AYXF01000001.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgctgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatgggaaccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5338 - DNA, 1490 bp, Mesorhizobium sp. L103C119B0
  ref <308>: DATABASE ACCESSION NUMBER: NCBI ACCESSION: NZ_AYXE01000015.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgctgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggaaaccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5339 - DNA, 1490 bp, Mesorhizobium sp. L103C120A0; identical to SEQ ID NO: 5337
  ref <308>: DATABASE ACCESSION NUMBER: NCBI ACCESSION: NZ_AYXD01000025.1
  ref <309>: DATABASE ENTRY DATE: 2019-04-01
  ref <313>: RELEVANT RESIDUES IN SEQ ID NO: (1)..(1490)

SEQ ID NO: 5340 - DNA, 1490 bp, Mesorhizobium sp. L103C131B0; identical to SEQ ID NO: 5337
  ref <308>: DATABASE ACCESSION NUMBER: NCBI ACCESSION: NZ_AYXC01000005.1
  ref <309>: DATABASE ENTRY DATE: 2019-04-01
  ref <313>: RELEVANT RESIDUES IN SEQ ID NO: (1)..(1490)

SEQ ID NO: 5341 - DNA, 1490 bp, Mesorhizobium sp. L103C565B0; identical to SEQ ID NO: 5338
  ref <308>: DATABASE ACCESSION NUMBER: NCBI ACCESSION: NZ_AYXB01000006.1
  ref <309>: DATABASE ENTRY DATE: 2019-04-01
  ref <313>: RELEVANT RESIDUES IN SEQ ID NO: (1)..(1490)

SEQ ID NO: 5342 - DNA, 1490 bp, Mesorhizobium sp. L2C054A000; identical to SEQ ID NO: 5338
  ref <308>: DATABASE ACCESSION NUMBER: NCBI ACCESSION: NZ_AYXA01000001.1
  ref <309>: DATABASE ENTRY DATE: 2019-04-01
  ref <313>: RELEVANT RESIDUES IN SEQ ID NO: (1)..(1490)

SEQ ID NO: 5343 - DNA, 1490 bp, Mesorhizobium sp. L2C066B000; identical to SEQ ID NO: 5338
  ref <308>: DATABASE ACCESSION NUMBER: NCBI ACCESSION: NZ_AYWZ01000003.1
  ref <309>: DATABASE ENTRY DATE: 2019-04-01
  ref <313>: RELEVANT RESIDUES IN SEQ ID NO: (1)..(1490)

SEQ ID NO: 5344 - DNA, 1564 bp, Mesorhizobium sp. L2C067A000
  misc_feature (961)..(961): n is a, c, g, or t
  ref <308>: DATABASE ACCESSION NUMBER: NCBI ACCESSION: NZ_AYWY01000007.1
  ref <309>: DATABASE ENTRY DATE: 2019-04-01
  ref <313>: RELEVANT RESIDUES IN SEQ ID NO: (1)..(1564)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgctgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggnatgtggtttaattcgaagcaacgcgcagaaccttaccagcccttgacatcccggtcgcggtttccagagatggaaaccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5345 - DNA, 1490 bp, Mesorhizobium sp. L2C084A000
  ref <308>: DATABASE ACCESSION NUMBER: NCBI ACCESSION: NZ_AYWX01000005.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5346 - DNA, 1490 bp, Mesorhizobium sp. L2C085B000; identical to SEQ ID NO: 5338
  ref <308>: DATABASE ACCESSION NUMBER: NCBI ACCESSION: NZ_AYWW01000001.1
  ref <309>: DATABASE ENTRY DATE: 2019-04-01
  ref <313>: RELEVANT RESIDUES IN SEQ ID NO: (1)..(1490)

SEQ ID NO: 5347 - DNA, 1490 bp, Mesorhizobium sp. L2C089B000; identical to SEQ ID NO: 5338
  ref <308>: DATABASE ACCESSION NUMBER: NCBI ACCESSION: NZ_AYWV01000002.1
  ref <309>: DATABASE ENTRY DATE: 2019-04-01
  ref <313>: RELEVANT RESIDUES IN SEQ ID NO: (1)..(1490)

SEQ ID NO: 5348 - DNA, 1490 bp, Mesorhizobium sp. L48C026A00
  ref <308>: DATABASE ACCESSION NUMBER: NCBI ACCESSION: NZ_AYWU01000002.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttatggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtctccagagatggagaccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5349 - DNA, 1482 bp, Mesorhizobium sp. LA-28
  ref <308>: DATABASE ACCESSION NUMBER: NCBI ACCESSION: NZ_QURN01000031.1
  ref <309>: DATABASE ENTRY DATE: 2019-04-01
  ref <313>: RELEVANT RESIDUES IN SEQ ID NO: (1)..(1482)
aacttgagagtttgatcctggctcagaacgaacgctggcggcaggcttaacacatgcaagtcgagcgcgtagcaatacgagcggcagacgggtgagtaacgcgtgggaatctacccatctctacggaacaactccgggaaactggagctaataccgtatacgtccttcgggagaaagatttatcggggatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatatttaagtcaggggtgaaatcccgaggctcaacctcggaactgcctttgatactgggtatctagagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaactatgagagctagccgtcggtaagtttacttatcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatgtccgtgaccggctcgagagatcgagctttctcttcggagcacggagcacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgtactctgcaactcgagtacatgaagttggaatcgctagtaatcgcggatcagcatgccgcggtgaatacgttcccgggccttgtacacaccgcccgtcacaccatgggagttggttctacccgaaggcgctgcgctaaccgcaaggaggcaggcgaccacggtagggtcagcgactggggtgaagtcgtaacaaggtagccgtaggggaacctgcggctggatcacctccttt

SEQ ID NO: 5350 - DNA, 1493 bp, Mesorhizobium sp. LC103
  ref <308>: DATABASE ACCESSION NUMBER: NCBI ACCESSION: NZ_LBCQ01000022.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcaggcttaacacatgcaagtcgagcgccccgcaaggggagcggcagacgggtgagtaacgcgtgggaatctacccatctctacggaataactcagggaaacttgaactaataccgtatacgtccttagggagaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctctgatactgggtgtctagagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgtcggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttacgagagatcgtatccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggctttacccgaaggcgctgtgctaaccgcaaggaggcaggcgaccacggtagggtcagcgactggggtgaagtcgtaacaaggtagccgtaggggaacctgcggctggatcacctcctttctaaggaag

SEQ ID NO: 5351 - DNA, 1489 bp, Mesorhizobium sp. LCM 4577
  ref <308>: DATABASE ACCESSION NUMBER: NCBI ACCESSION: NZ_MDDU01000040.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcarccgcggtaatacgaagggggctagcgttgttcggaattactgggcgtaaagcgcacgtaggcggatacttaagtcaggggtgaaatcccggggctcaaccccggaactgcctttgatactgggtatctggagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcrgctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5352 - DNA, 1491 bp, Mesorhizobium sp. LNHC209A00
  ref <308>: DATABASE ACCESSION NUMBER: NCBI ACCESSION: NZ_AYWT01000003.1
  ref <309>: DATABASE ENTRY DATE: 2019-04-01
  ref <313>: RELEVANT RESIDUES IN SEQ ID NO: (1)..(1491)
caacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5353 - DNA, 1491 bp, Mesorhizobium sp. LNHC220B00; identical to SEQ ID NO: 5352
  ref <308>: DATABASE ACCESSION NUMBER: NCBI ACCESSION: NZ_AYWS01000008.1
  ref <309>: DATABASE ENTRY DATE: 2019-04-01
  ref <313>: RELEVANT RESIDUES IN SEQ ID NO: (1)..(1491)

SEQ ID NO: 5354 - DNA, 1490 bp, Mesorhizobium sp. LNHC221B00
  ref <308>: DATABASE ACCESSION NUMBER: NCBI ACCESSION: NZ_AYWR01000030.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggaaaccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5355 - DNA, 1491 bp, Mesorhizobium sp. LNHC229A00; identical to SEQ ID NO: 5352
  ref <308>: DATABASE ACCESSION NUMBER: NCBI ACCESSION: NZ_AYWQ01000002.1
  ref <309>: DATABASE ENTRY DATE: 2019-04-01
  ref <313>: RELEVANT RESIDUES IN SEQ ID NO: (1)..(1491)

SEQ ID NO: 5356 - DNA, 1490 bp, Mesorhizobium sp. LNHC232B00; identical to SEQ ID NO: 5354
  ref <308>: DATABASE ACCESSION NUMBER: NCBI ACCESSION: NZ_AYWP01000002.1
  ref <309>: DATABASE ENTRY DATE: 2019-04-01
  ref <313>: RELEVANT RESIDUES IN SEQ ID NO: (1)..(1490)

SEQ ID NO: 5357 - DNA, 1737 bp, Mesorhizobium sp. LNHC252B00
  misc_feature (416)..(416): n is a, c, g, or t
  ref <308>: DATABASE ACCESSION NUMBER: NCBI ACCESSION: NZ_AYWO01000002.1
  ref <309>: DATABASE ENTRY DATE: 2019-04-01
  ref <313>: RELEVANT RESIDUES IN SEQ ID NO: (1)..(1737)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagnggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5358 - DNA, 1036 bp, Mesorhizobium sp. LNJC372A00
  ref <308>: DATABASE ACCESSION NUMBER: NCBI ACCESSION: NZ_AYWN01000015.1
  ref <309>: DATABASE ENTRY DATE: 2019-04-01
  ref <313>: RELEVANT RESIDUES IN SEQ ID NO: (1)..(1036)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgctgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggaaaccttcagttcggctggaccggtgacaggtgctgcatggctgtcgtcagctcgtgtcgtgagatgttgggttaa

SEQ ID NO: 5359 - DNA, 1034 bp, Mesorhizobium sp. LNJC374B00
  ref <308>: DATABASE ACCESSION NUMBER: NCBI ACCESSION: NZ_AYWM01000003.1
  ref <309>: DATABASE ENTRY DATE: 2019-04-01
  ref <313>: RELEVANT RESIDUES IN SEQ ID NO: (1)..(1034)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgctgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggaaaccttcagttcggctggaccggtgacaggtgctgcatggctgtcgtcagctcgtgtcgtgagatgttgggtt

SEQ ID NO: 5360 - DNA, 1490 bp, Mesorhizobium sp. LNJC380A00; identical to SEQ ID NO: 5338
  ref <308>: DATABASE ACCESSION NUMBER: NCBI ACCESSION: NZ_AYWL01000003.1
  ref <309>: DATABASE ENTRY DATE: 2019-04-01
  ref <313>: RELEVANT RESIDUES IN SEQ ID NO: (1)..(1490)

SEQ ID NO: 5361 - DNA, 1490 bp, Mesorhizobium sp. LNJC384A00; identical to SEQ ID NO: 5338
  ref <308>: DATABASE ACCESSION NUMBER: NCBI ACCESSION: NZ_AYWK01000005.1
  ref <309>: DATABASE ENTRY DATE: 2019-04-01
  ref <313>: RELEVANT RESIDUES IN SEQ ID NO: (1)..(1490)

SEQ ID NO: 5362 - DNA, 1490 bp, Mesorhizobium sp. LNJC386A00; identical to SEQ ID NO: 5337
  ref <308>: DATABASE ACCESSION NUMBER: NCBI ACCESSION: NZ_AYWJ01000001.1
  ref <309>: DATABASE ENTRY DATE: 2019-04-01
  ref <313>: RELEVANT RESIDUES IN SEQ ID NO: (1)..(1490)

SEQ ID NO: 5363 - DNA, 1490 bp, Mesorhizobium sp. LNJC391B00; identical to SEQ ID NO: 5338
  ref <308>: DATABASE ACCESSION NUMBER: NCBI ACCESSION: NZ_AYWI01000003.1
  ref <309>: DATABASE ENTRY DATE: 2019-04-01
  ref <313>: RELEVANT RESIDUES IN SEQ ID NO: (1)..(1490)

SEQ ID NO: 5364 - DNA, 1490 bp, Mesorhizobium sp. LNJC394B00; identical to SEQ ID NO: 5337
  ref <308>: DATABASE ACCESSION NUMBER: NCBI ACCESSION: NZ_AYWH01000002.1
  ref <309>: DATABASE ENTRY DATE: 2019-04-01
  ref <313>: RELEVANT RESIDUES IN SEQ ID NO: (1)..(1490)

SEQ ID NO: 5365 - DNA, 1490 bp, Mesorhizobium sp. LNJC395A00; identical to SEQ ID NO: 5338
  ref <308>: DATABASE ACCESSION NUMBER: NCBI ACCESSION: NZ_AYWG01000019.1
  ref <309>: DATABASE ENTRY DATE: 2019-04-01
  ref <313>: RELEVANT RESIDUES IN SEQ ID NO: (1)..(1490)

SEQ ID NO: 5366 - DNA, 1490 bp, Mesorhizobium sp. LNJC398B00; identical to SEQ ID NO: 5337
  ref <308>: DATABASE ACCESSION NUMBER: NCBI ACCESSION: NZ_AYWF01000001.1
  ref <309>: DATABASE ENTRY DATE: 2019-04-01
  ref <313>: RELEVANT RESIDUES IN SEQ ID NO: (1)..(1490)

SEQ ID NO: 5367 - DNA, 1490 bp, Mesorhizobium sp. LNJC399B00; identical to SEQ ID NO: 5338
  ref <308>: DATABASE ACCESSION NUMBER: NCBI ACCESSION: NZ_AYWE01000001.1
  ref <309>: DATABASE ENTRY DATE: 2019-04-01
  ref <313>: RELEVANT RESIDUES IN SEQ ID NO: (1)..(1490)

SEQ ID NO: 5368 - DNA, 1490 bp, Mesorhizobium sp. LNJC403B00; identical to SEQ ID NO: 5338
  ref <308>: DATABASE ACCESSION NUMBER: NCBI ACCESSION: NZ_AYWD01000003.1
  ref <309>: DATABASE ENTRY DATE: 2019-04-01
  ref <313>: RELEVANT RESIDUES IN SEQ ID NO: (1)..(1490)

SEQ ID NO: 5369 - DNA, 1490 bp, Mesorhizobium sp. LNJC405B00; identical to SEQ ID NO: 5338
  ref <308>: DATABASE ACCESSION NUMBER: NCBI ACCESSION: NZ_AYWC01000001.1
  ref <309>: DATABASE ENTRY DATE: 2019-04-01
  ref <313>: RELEVANT RESIDUES IN SEQ ID NO: (1)..(1490)

SEQ ID NO: 5370 - DNA, 1490 bp, Mesorhizobium sp. LSHC412B00; identical to SEQ ID NO: 5337
  ref <308>: DATABASE ACCESSION NUMBER: NCBI ACCESSION: NZ_AYWB01000007.1
  ref <309>: DATABASE ENTRY DATE: 2019-04-01
  ref <313>: RELEVANT RESIDUES IN SEQ ID NO: (1)..(1490)

SEQ ID NO: 5371 - DNA, 1490 bp, Mesorhizobium sp. LSHC414A00; identical to SEQ ID NO: 5338
  ref <308>: DATABASE ACCESSION NUMBER: NCBI ACCESSION: NZ_AYWA01000009.1
  ref <309>: DATABASE ENTRY DATE: 2019-04-01
  ref <313>: RELEVANT RESIDUES IN SEQ ID NO: (1)..(1490)

SEQ ID NO: 5372 - DNA, 1490 bp, Mesorhizobium sp. LSHC416B00; identical to SEQ ID NO: 5338
  ref <308>: DATABASE ACCESSION NUMBER: NCBI ACCESSION: NZ_AYVZ01000013.1
  ref <309>: DATABASE ENTRY DATE: 2019-04-01
  ref <313>: RELEVANT RESIDUES IN SEQ ID NO: (1)..(1490)

SEQ ID NO: 5373 - DNA, 1490 bp, Mesorhizobium sp. LSHC420B00
  ref <308>: DATABASE ACCESSION NUMBER: NCBI ACCESSION: NZ_AYVY01000036.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5374 - DNA, 1490 bp, Mesorhizobium sp. LSHC422A00; identical to SEQ ID NO: 5337
  ref <308>: DATABASE ACCESSION NUMBER: NCBI ACCESSION: NZ_AYVX01000008.1
  ref <309>: DATABASE ENTRY DATE: 2019-04-01
  ref <313>: RELEVANT RESIDUES IN SEQ ID NO: (1)..(1490)

SEQ ID NO: 5375 - DNA, 1490 bp, Mesorhizobium sp. LSHC424B00; identical to SEQ ID NO: 5338
  ref <308>: DATABASE ACCESSION NUMBER: NCBI ACCESSION: NZ_AYVW01000011.1
  ref <309>: DATABASE ENTRY DATE: 2019-04-01
  ref <313>: RELEVANT RESIDUES IN SEQ ID NO: (1)..(1490)

SEQ ID NO: 5376 - DNA, 1490 bp, Mesorhizobium sp. LSHC426A00; identical to SEQ ID NO: 5338
  ref <308>: DATABASE ACCESSION NUMBER: NCBI ACCESSION: NZ_AYVV01000021.1
  ref <309>: DATABASE ENTRY DATE: 2019-04-01
  ref <313>: RELEVANT RESIDUES IN SEQ ID NO: (1)..(1490)

SEQ ID NO: 5377 - DNA, 1490 bp, Mesorhizobium sp. LSHC432A00; identical to SEQ ID NO: 5338
  ref <308>: DATABASE ACCESSION NUMBER: NCBI ACCESSION: NZ_AYVU01000001.1
  ref <309>: DATABASE ENTRY DATE: 2019-04-01
  ref <313>: RELEVANT RESIDUES IN SEQ ID NO: (1)..(1490)

SEQ ID NO: 5378 - DNA, 1490 bp, Mesorhizobium sp. LSHC440A00; identical to SEQ ID NO: 5338
  ref <308>: DATABASE ACCESSION NUMBER: NCBI ACCESSION: NZ_AYVT01000001.1
  ref <309>: DATABASE ENTRY DATE: 2019-04-01
  ref <313>: RELEVANT RESIDUES IN SEQ ID NO: (1)..(1490)

SEQ ID NO: 5379 - DNA, 1490 bp, Mesorhizobium sp. LSHC440B00; identical to SEQ ID NO: 5338
  ref <308>: DATABASE ACCESSION NUMBER: NCBI ACCESSION: NZ_AYVS01000001.1
  ref <309>: DATABASE ENTRY DATE: 2019-04-01
  ref <313>: RELEVANT RESIDUES IN SEQ ID NO: (1)..(1490)

SEQ ID NO: 5380 - DNA, 1490 bp, Mesorhizobium sp. LSJC255A00; identical to SEQ ID NO: 5338
  ref <308>: DATABASE ACCESSION NUMBER: NCBI ACCESSION: NZ_AYVR01000003.1
  ref <309>: DATABASE ENTRY DATE: 2019-04-01
  ref <313>: RELEVANT RESIDUES IN SEQ ID NO: (1)..(1490)

SEQ ID NO: 5381 - DNA, 1490 bp, Mesorhizobium sp. LSJC264A00; identical to SEQ ID NO: 5338
  ref <308>: DATABASE ACCESSION NUMBER: NCBI ACCESSION: NZ_AYVQ01000016.1
  ref <309>: DATABASE ENTRY DATE: 2019-04-01
  ref <313>: RELEVANT RESIDUES IN SEQ ID NO: (1)..(1490)

SEQ ID NO: 5382 - DNA, 1490 bp, Mesorhizobium sp. LSJC265A00; identical to SEQ ID NO: 5338
  ref <308>: DATABASE ACCESSION NUMBER: NCBI ACCESSION: NZ_AYVP01000045.1
  ref <309>: DATABASE ENTRY DATE: 2019-04-01
  ref <313>: RELEVANT RESIDUES IN SEQ ID NO: (1)..(1490)

SEQ ID NO: 5383 - DNA, 1490 bp, Mesorhizobium sp. LSJC268A00; identical to SEQ ID NO: 5338
  ref <308>: DATABASE ACCESSION NUMBER: NCBI ACCESSION: NZ_AYVO01000001.1
  ref <309>: DATABASE ENTRY DATE: 2019-04-01
  ref <313>: RELEVANT RESIDUES IN SEQ ID NO: (1)..(1490)

SEQ ID NO: 5384 - DNA, 1490 bp, Mesorhizobium sp. LSJC269B00; identical to SEQ ID NO: 5337
  ref <308>: DATABASE ACCESSION NUMBER: NCBI ACCESSION: NZ_AYVN01000001.1
  ref <309>: DATABASE ENTRY DATE: 2019-04-01
  ref <313>: RELEVANT RESIDUES IN SEQ ID NO: (1)..(1490)

SEQ ID NO: 5385 - DNA, 1491 bp, Mesorhizobium sp. LSJC277A00
  ref <308>: DATABASE ACCESSION NUMBER: NCBI ACCESSION: NZ_AYVM01000031.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgctgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggaaaccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5386 - DNA, 1490 bp, Mesorhizobium sp. LSJC280B00
  ref <308>: DATABASE ACCESSION NUMBER: NCBI ACCESSION: NZ_AYVL01000004.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgctgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5387 - DNA, 1490 bp, Mesorhizobium sp. LSJC285A00; identical to SEQ ID NO: 5337
  ref <308>: DATABASE ACCESSION NUMBER: NCBI ACCESSION: NZ_AYVK01000049.1
  ref <309>: DATABASE ENTRY DATE: 2019-04-01
  ref <313>: RELEVANT RESIDUES IN SEQ ID NO: (1)..(1490)

SEQ ID NO: 5388 - DNA, 1489 bp, Mesorhizobium sp. M00.F.Ca.ET.149.01.1.1
  ref <308>: DATABASE ACCESSION NUMBER: NCBI ACCESSION: NZ_SADH01000012.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttatggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5389 - DNA, 1489 bp, Mesorhizobium sp. M00.F.Ca.ET.151.01.1.1
  ref <308>: DATABASE ACCESSION NUMBER: NCBI ACCESSION: NZ_SADI01000001.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctggagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagaaatggaaaccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5390 - DNA, 1489 bp, Mesorhizobium sp. M00.F.Ca.ET.158.01.1.1
  ref <308>: DATABASE ACCESSION NUMBER: NCBI ACCESSION: NZ_SADL01000004.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagaaatggataccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5391 - DNA, 1489 bp, Mesorhizobium sp. M00.F.Ca.ET.170.01.1.1
  ref <308>: DATABASE ACCESSION NUMBER: NCBI ACCESSION: NZ_SADN01000029.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctggagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5392 - DNA, 1489 bp, Mesorhizobium sp. M00.F.Ca.ET.186.01.1.1
  ref <308>: DATABASE ACCESSION NUMBER: NCBI ACCESSION: NZ_SADO01000014.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctggagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5393 - DNA, 1489 bp, Mesorhizobium sp. M00.F.Ca.ET.216.01.1.1
  ref <308>: DATABASE ACCESSION NUMBER: NCBI ACCESSION: NZ_SADR01000003.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgctgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5394 - DNA, 1489 bp, Mesorhizobium sp. M00.F.Ca.ET.217.01.1.1; identical to SEQ ID NO: 5390
  ref <308>: DATABASE ACCESSION NUMBER: NCBI ACCESSION: NZ_SADS01000005.1
  ref <309>: DATABASE ENTRY DATE: 2019-04-01
  ref <313>: RELEVANT RESIDUES IN SEQ ID NO: (1)..(1489)

SEQ ID NO: 5395 - DNA, 1489 bp, Mesorhizobium sp. M00.F.Ca.ET.220.01.1.1; identical to SEQ ID NO: 5389
  ref <308>: DATABASE ACCESSION NUMBER: NCBI ACCESSION: NZ_SADU01000001.1
  ref <309>: DATABASE ENTRY DATE: 2019-04-01
  ref <313>: RELEVANT RESIDUES IN SEQ ID NO: (1)..(1489)

SEQ ID NO: 5396 - DNA, 1489 bp, Mesorhizobium sp. M1A.F.Ca.ET.072.01.1.1; identical to SEQ ID NO: 5390
  ref <308>: DATABASE ACCESSION NUMBER: NCBI ACCESSION: NZ_RZSF01000216.1
  ref <309>: DATABASE ENTRY DATE: 2019-04-01
  ref <313>: RELEVANT RESIDUES IN SEQ ID NO: (1)..(1489)

SEQ ID NO: 5397 - DNA, 1489 bp, Mesorhizobium sp. M1A.F.Ca.IN.020.03.1.1; identical to SEQ ID NO: 5390
  ref <308>: DATABASE ACCESSION NUMBER: NCBI ACCESSION: NZ_RZSQ01000557.1
  ref <309>: DATABASE ENTRY DATE: 2019-04-01
  ref <313>: RELEVANT RESIDUES IN SEQ ID NO: (1)..(1489)

SEQ ID NO: 5398 - DNA, 1489 bp, Mesorhizobium sp. M1A.F.Ca.IN.020.03.2.1; identical to SEQ ID NO: 5390
  ref <308>: DATABASE ACCESSION NUMBER: NCBI ACCESSION: NZ_RZSV01000021.1
  ref <309>: DATABASE ENTRY DATE: 2019-04-01
  ref <313>: RELEVANT RESIDUES IN SEQ ID NO: (1)..(1489)

SEQ ID NO: 5399 - DNA, 1489 bp, Mesorhizobium sp. M1A.F.Ca.IN.020.04.1.1; identical to SEQ ID NO: 5390
  ref <308>: DATABASE ACCESSION NUMBER: NCBI ACCESSION: NZ_RZSN01000230.1
  ref <309>: DATABASE ENTRY DATE: 2019-04-01
  ref <313>: RELEVANT RESIDUES IN SEQ ID NO: (1)..(1489)

SEQ ID NO: 5400 - DNA, 1489 bp, Mesorhizobium sp. M1A.F.Ca.IN.020.06.1.1; identical to SEQ ID NO: 5390
  ref <308>: DATABASE ACCESSION NUMBER: NCBI ACCESSION: NZ_RZSR01000040.1
  ref <309>: DATABASE ENTRY DATE: 2019-04-01
  ref <313>: RELEVANT RESIDUES IN SEQ ID NO: (1)..(1489)

SEQ ID NO: 5401 - DNA, 1489 bp, Mesorhizobium sp. M1A.F.Ca.IN.020.30.1.1; identical to SEQ ID NO: 5390
  ref <308>: DATABASE ACCESSION NUMBER: NCBI ACCESSION: NZ_RZSO01000021.1
  ref <309>: DATABASE ENTRY DATE: 2019-04-01
  ref <313>: RELEVANT RESIDUES IN SEQ ID NO: (1)..(1489)

SEQ ID NO: 5402 - DNA, 1489 bp, Mesorhizobium sp. M1A.F.Ca.IN.020.32.1.1; identical to SEQ ID NO: 5390
  ref <308>: DATABASE ACCESSION NUMBER: NCBI ACCESSION: NZ_RZSP01000103.1
  ref <309>: DATABASE ENTRY DATE: 2019-04-01
  ref <313>: RELEVANT RESIDUES IN SEQ ID NO: (1)..(1489)

SEQ ID NO: 5403 - DNA, 1489 bp, Mesorhizobium sp. M1A.F.Ca.IN.022.02.1.1; identical to SEQ ID NO: 5390
  ref <308>: DATABASE ACCESSION NUMBER: NCBI ACCESSION: NZ_RZSS01000153.1
  ref <309>: DATABASE ENTRY DATE: 2019-04-01
  ref <313>: RELEVANT RESIDUES IN SEQ ID NO: (1)..(1489)

SEQ ID NO: 5404 - DNA, 1489 bp, Mesorhizobium sp. M1A.F.Ca.IN.022.04.1.1; identical to SEQ ID NO: 5390
  ref <308>: DATABASE ACCESSION NUMBER: NCBI ACCESSION: NZ_RZSZ01000143.1
  ref <309>: DATABASE ENTRY DATE: 2019-04-01
  ref <313>: RELEVANT RESIDUES IN SEQ ID NO: (1)..(1489)

SEQ ID NO: 5405 - DNA, 1489 bp, Mesorhizobium sp. M1A.F.Ca.IN.022.05.2.1; identical to SEQ ID NO: 5390
  ref <308>: DATABASE ACCESSION NUMBER: NCBI ACCESSION: NZ_RZSM01000128.1
  ref <309>: DATABASE ENTRY DATE: 2019-04-01
  ref <313>: RELEVANT RESIDUES IN SEQ ID NO: (1)..(1489)

SEQ ID NO: 5406 - DNA, 1489 bp, Mesorhizobium sp. M1A.F.Ca.IN.022.07.1.1; identical to SEQ ID NO: 5390
  ref <308>: DATABASE ACCESSION NUMBER: NCBI ACCESSION: NZ_RZST01000108.1
  ref <309>: DATABASE ENTRY DATE: 2019-04-01
  ref <313>: RELEVANT RESIDUES IN SEQ ID NO: (1)..(1489)

SEQ ID NO: 5407 - DNA, 1489 bp, Mesorhizobium sp. M1A.T.Ca.IN.004.03.1.1; identical to SEQ ID NO: 5390
  ref <308>: DATABASE ACCESSION NUMBER: NCBI ACCESSION: NZ_RZTV01000004.1
  ref <309>: DATABASE ENTRY DATE: 2019-04-01
  ref <313>: RELEVANT RESIDUES IN SEQ ID NO: (1)..(1489)

SEQ ID NO: 5408 - DNA, 1489 bp, Mesorhizobium sp. M1B.F.Ca.ET.045.04.1.1
  ref <308>: DATABASE ACCESSION NUMBER: NCBI ACCESSION: NZ_CP034448.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5409 - DNA, 1489 bp, Mesorhizobium sp. M1C.F.Ca.ET.192.01.1.1; identical to SEQ ID NO: 5408
  ref <308>: DATABASE ACCESSION NUMBER: NCBI ACCESSION: NZ_RZOX01000001.1
  ref <309>: DATABASE ENTRY DATE: 2019-04-01
  ref <313>: RELEVANT RESIDUES IN SEQ ID NO: (1)..(1489)

SEQ ID NO: 5410 - DNA, 1489 bp, Mesorhizobium sp. M1C.F.Ca.ET.212.01.1.1; identical to SEQ ID NO: 5408
  ref <308>: DATABASE ACCESSION NUMBER: NCBI ACCESSION: NZ_SADQ01000001.1
  ref <309>: DATABASE ENTRY DATE: 2019-04-01
  ref <313>: RELEVANT RESIDUES IN SEQ ID NO: (1)..(1489)

SEQ ID NO: 5411 - DNA, 1489 bp, Mesorhizobium sp. M1D.F.Ca.ET.043.01.1.1
  ref <308>: DATABASE ACCESSION NUMBER: NCBI ACCESSION: NZ_CP034444.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5412 - DNA, 1489 bp, Mesorhizobium sp. M1D.F.Ca.ET.183.01.1.1
  ref <308>: DATABASE ACCESSION NUMBER: NCBI ACCESSION: NZ_RZOW01000036.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctggagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5413 - DNA, 1489 bp, Mesorhizobium sp. M1D.F.Ca.ET.231.01.1.1; identical to SEQ ID NO: 5412
  ref <308>: DATABASE ACCESSION NUMBER: NCBI ACCESSION: NZ_RZOZ01000035.1
  ref <309>: DATABASE ENTRY DATE: 2019-04-01
  ref <313>: RELEVANT RESIDUES IN SEQ ID NO: (1)..(1489)

SEQ ID NO: 5414 - DNA, 1489 bp, Mesorhizobium sp. M1E.F.Ca.ET.041.01.1.1
  ref <308>: DATABASE ACCESSION NUMBER: NCBI ACCESSION: NZ_RZSL01000141.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttatggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5415 - DNA, 1489 bp, Mesorhizobium sp. M1E.F.Ca.ET.045.02.1.1; identical to SEQ ID NO: 5414
  ref <308>: DATABASE ACCESSION NUMBER: NCBI ACCESSION: NZ_CP034447.1
  ref <309>: DATABASE ENTRY DATE: 2019-04-01
  ref <313>: RELEVANT RESIDUES IN SEQ ID NO: (1)..(1489)

SEQ ID NO: 5416 - DNA, 1489 bp, Mesorhizobium sp. M1E.F.Ca.ET.063.01.1.1; identical to SEQ ID NO: 5414
  ref <308>: DATABASE ACCESSION NUMBER: NCBI ACCESSION: NZ_RZSC01000154.1
  ref <309>: DATABASE ENTRY DATE: 2019-04-01
  ref <313>: RELEVANT RESIDUES IN SEQ ID NO: (1)..(1489)

SEQ ID NO: 5417 - DNA, 1489 bp, Mesorhizobium sp. M2A.F.Ca.ET.015.02.1.1; identical to SEQ ID NO: 5392
  ref <308>: DATABASE ACCESSION NUMBER: NCBI ACCESSION: NZ_RZSK01000033.1
  ref <309>: DATABASE ENTRY DATE: 2019-04-01
  ref <313>: RELEVANT RESIDUES IN SEQ ID NO: (1)..(1489)

SEQ ID NO: 5418 - DNA, 1489 bp, Mesorhizobium sp. M2A.F.Ca.ET.017.03.2.1
  ref <308>: DATABASE ACCESSION NUMBER: NCBI ACCESSION: NZ_RZOG01000036.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctagccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctggagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5419 - DNA, 1489 bp, Mesorhizobium sp. M2A.F.Ca.ET.029.05.1.1; identical to SEQ ID NO: 5392
  ref <308>: DATABASE ACCESSION NUMBER: NCBI ACCESSION: NZ_RZOO01000030.1
  ref <309>: DATABASE ENTRY DATE: 2019-04-01
  ref <313>: RELEVANT RESIDUES IN SEQ ID NO: (1)..(1489)

SEQ ID NO: 5420 - DNA, 1489 bp, Mesorhizobium sp. M2A.F.Ca.ET.037.01.1.1
  ref <308>: DATABASE ACCESSION NUMBER: NCBI ACCESSION: NZ_RZSA01000322.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctggagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagaaatggattccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5421 - DNA, 1489 bp, Mesorhizobium sp. M2A.F.Ca.ET.039.01.1.1; identical to SEQ ID NO: 5420
  ref <308>: DATABASE ACCESSION NUMBER: NCBI ACCESSION: NZ_RZRY01000306.1
  ref <309>: DATABASE ENTRY DATE: 2019-04-01
  ref <313>: RELEVANT RESIDUES IN SEQ ID NO: (1)..(1489)

SEQ ID NO: 5422 - DNA, 1489 bp, Mesorhizobium sp. M2A.F.Ca.ET.042.01.1.1; identical to SEQ ID NO: 5392
  ref <308>: DATABASE ACCESSION NUMBER: NCBI ACCESSION: NZ_RZRX01000303.1
  ref <309>: DATABASE ENTRY DATE: 2019-04-01
  ref <313>: RELEVANT RESIDUES IN SEQ ID NO: (1)..(1489)

SEQ ID NO: 5423 - DNA, 1489 bp, Mesorhizobium sp. M2A.F.Ca.ET.043.02.1.1; identical to SEQ ID NO: 5392
  ref <308>: DATABASE ACCESSION NUMBER: NCBI ACCESSION: NZ_CP034445.1
  ref <309>: DATABASE ENTRY DATE: 2019-04-01
  ref <313>: RELEVANT RESIDUES IN SEQ ID NO: (1)..(1489)

SEQ ID NO: 5424 - DNA, 1488 bp, Mesorhizobium sp. M2A.F.Ca.ET.043.05.1.1
  ref <308>: DATABASE ACCESSION NUMBER: NCBI ACCESSION: NZ_CP034446.1
  ref <309>: DATABASE ENTRY DATE: 2019-04-01
  ref <313>: RELEVANT RESIDUES IN SEQ ID NO: (1)..(1488)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctggagtccggaagaggtgagtggaattccgagtgtagaggtgaaattcgtagatattcggaggaacaccagtggcgaaggcggctcactggtccggtactgacgctgaggtgcgaaagcgtgggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5425 - DNA, 1489 bp, Mesorhizobium sp. M2A.F.Ca.ET.046.03.2.1; identical to SEQ ID NO: 5420
  ref <308>: DATABASE ACCESSION NUMBER: NCBI ACCESSION: NZ_CP034449.1
  ref <309>: DATABASE ENTRY DATE: 2019-04-01
  ref <313>: RELEVANT RESIDUES IN SEQ ID NO: (1)..(1489)

SEQ ID NO: 5426 - DNA, 1489 bp, Mesorhizobium sp. M2A.F.Ca.ET.067.02.1.1; identical to SEQ ID NO: 5392
  ref <308>: DATABASE ACCESSION NUMBER: NCBI ACCESSION: NZ_RZSB01000112.1
  ref <309>: DATABASE ENTRY DATE: 2019-04-01
  ref <313>: RELEVANT RESIDUES IN SEQ ID NO: (1)..(1489)

SEQ ID NO: 5427 - DNA, 1489 bp, Mesorhizobium sp. M2D.F.Ca.ET.140.01.1.1; identical to SEQ ID NO: 5389
  ref <308>: DATABASE ACCESSION NUMBER: NCBI ACCESSION: NZ_RZOU01000002.1
  ref <309>: DATABASE ENTRY DATE: 2019-04-01
  ref <313>: RELEVANT RESIDUES IN SEQ ID NO: (1)..(1489)

SEQ ID NO: 5428 - DNA, 1489 bp, Mesorhizobium sp. M2D.F.Ca.ET.148.01.1.1; identical to SEQ ID NO: 5389
  ref <308>: DATABASE ACCESSION NUMBER: NCBI ACCESSION: NZ_RZOV01000001.1
  ref <309>: DATABASE ENTRY DATE: 2019-04-01
  ref <313>: RELEVANT RESIDUES IN SEQ ID NO: (1)..(1489)

SEQ ID NO: 5429 - DNA, 1489 bp, Mesorhizobium sp. M2D.F.Ca.ET.153.01.1.1; identical to SEQ ID NO: 5389
  ref <308>: DATABASE ACCESSION NUMBER: NCBI ACCESSION: NZ_SADJ01000001.1
  ref <309>: DATABASE ENTRY DATE: 2019-04-01
  ref <313>: RELEVANT RESIDUES IN SEQ ID NO: (1)..(1489)

SEQ ID NO: 5430 - DNA, 1489 bp, Mesorhizobium sp. M2D.F.Ca.ET.226.01.1.1; identical to SEQ ID NO: 5389
  ref <308>: DATABASE ACCESSION NUMBER: NCBI ACCESSION: NZ_RZOY01000001.1
  ref <309>: DATABASE ENTRY DATE: 2019-04-01
  ref <313>: RELEVANT RESIDUES IN SEQ ID NO: (1)..(1489)

SEQ ID NO: 5431 - DNA, 1489 bp, Mesorhizobium sp. M2D.F.Ca.ET.232.01.1.1; identical to SEQ ID NO: 5389
  ref <308>: DATABASE ACCESSION NUMBER: NCBI ACCESSION: NZ_RZPA01000001.1
  ref <309>: DATABASE ENTRY DATE: 2019-04-01
  ref <313>: RELEVANT RESIDUES IN SEQ ID NO: (1)..(1489)

SEQ ID NO: 5432 - DNA, 1489 bp, Mesorhizobium sp. M2E.F.Ca.ET.154.01.1.1; identical to SEQ ID NO: 5391
  ref <308>: DATABASE ACCESSION NUMBER: NCBI ACCESSION: NZ_SADK01000019.1
  ref <309>: DATABASE ENTRY DATE: 2019-04-01
  ref <313>: RELEVANT RESIDUES IN SEQ ID NO: (1)..(1489)

SEQ ID NO: 5433 - DNA, 1489 bp, Mesorhizobium sp. M2E.F.Ca.ET.166.01.1.1; identical to SEQ ID NO: 5391
  ref <308>: DATABASE ACCESSION NUMBER: NCBI ACCESSION: NZ_SADM01000031.1
  ref <309>: DATABASE ENTRY DATE: 2019-04-01
  ref <313>: RELEVANT RESIDUES IN SEQ ID NO: (1)..(1489)

SEQ ID NO: 5434 - DNA, 1489 bp, Mesorhizobium sp. M2E.F.Ca.ET.209.01.1.1; identical to SEQ ID NO: 5391
  ref <308>: DATABASE ACCESSION NUMBER: NCBI ACCESSION: NZ_SADP01000033.1
  ref <309>: DATABASE ENTRY DATE: 2019-04-01
  ref <313>: RELEVANT RESIDUES IN SEQ ID NO: (1)..(1489)

SEQ ID NO: 5435 - DNA, 1489 bp, Mesorhizobium sp. M2E.F.Ca.ET.219.01.1.1; identical to SEQ ID NO: 5391
  ref <308>: DATABASE ACCESSION NUMBER: NCBI ACCESSION: NZ_SADT01000007.1
  ref <309>: DATABASE ENTRY DATE: 2019-04-01
  ref <313>: RELEVANT RESIDUES IN SEQ ID NO: (1)..(1489)

SEQ ID NO: 5436 - DNA, 1489 bp, Mesorhizobium sp. M3A.F.Ca.ET.080.04.2.1
  ref <308>: DATABASE ACCESSION NUMBER: NCBI ACCESSION: NZ_CP034451.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttaccagaaatggtttccttcagttcggctggaccggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5437 - DNA, 1489 bp, Mesorhizobium sp. M4A.F.Ca.ET.020.02.1.1
  ref <308>: DATABASE ACCESSION NUMBER: NCBI ACCESSION: NZ_RZOI01000097.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgcgtagcaatacgagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5438 - DNA, 1489 bp, Mesorhizobium sp. M4A.F.Ca.ET.022.05.2.1; identical to SEQ ID NO: 5437
  ref <308>: DATABASE ACCESSION NUMBER: NCBI ACCESSION: NZ_RZOJ01000292.1
  ref <309>: DATABASE ENTRY DATE: 2019-04-01
  ref <313>: RELEVANT RESIDUES IN SEQ ID NO: (1)..(1489)

SEQ ID NO: 5439 - DNA, 1489 bp, Mesorhizobium sp. M4A.F.Ca.ET.050.02.1.1
  ref <308>: DATABASE ACCESSION NUMBER: NCBI ACCESSION: NZ_RZSG01000174.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgcgtagcaatacgagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgctgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5440 - DNA, 1489 bp, Mesorhizobium sp. M4A.F.Ca.ET.090.04.2.1; identical to SEQ ID NO: 5437
  ref <308>: DATABASE ACCESSION NUMBER: NCBI ACCESSION: NZ_RZOT01000054.1
  ref <309>: DATABASE ENTRY DATE: 2019-04-01
  ref <313>: RELEVANT RESIDUES IN SEQ ID NO: (1)..(1489)

SEQ ID NO: 5441 - DNA, 1489 bp, Mesorhizobium sp. M4B.F.Ca.ET.013.02.1.1; identical to SEQ ID NO: 5437
  ref <308>: DATABASE ACCESSION NUMBER: NCBI ACCESSION: NZ_RZSH01000319.1
  ref <309>: DATABASE ENTRY DATE: 2019-04-01
  ref <313>: RELEVANT RESIDUES IN SEQ ID NO: (1)..(1489)

SEQ ID NO: 5442 - DNA, 1489 bp, Mesorhizobium sp. M4B.F.Ca.ET.017.02.2.1; identical to SEQ ID NO: 5437
  ref <308>: DATABASE ACCESSION NUMBER: NCBI ACCESSION: NZ_RZOF01000038.1
  ref <309>: DATABASE ENTRY DATE: 2019-04-01
  ref <313>: RELEVANT RESIDUES IN SEQ ID NO: (1)..(1489)

SEQ ID NO: 5443 - DNA, 1489 bp, Mesorhizobium sp. M4B.F.Ca.ET.019.03.1.1; identical to SEQ ID NO: 5437
  ref <308>: DATABASE ACCESSION NUMBER: NCBI ACCESSION: NZ_RZOH01000030.1
  ref <309>: DATABASE ENTRY DATE: 2019-04-01
  ref <313>: RELEVANT RESIDUES IN SEQ ID NO: (1)..(1489)

SEQ ID NO: 5444 - DNA, 1489 bp, Mesorhizobium sp. M4B.F.Ca.ET.049.02.1.2; identical to SEQ ID NO: 5437
  ref <308>: DATABASE ACCESSION NUMBER: NCBI ACCESSION: NZ_RZSE01000038.1
  ref <309>: DATABASE ENTRY DATE: 2019-04-01
  ref <313>: RELEVANT RESIDUES IN SEQ ID NO: (1)..(1489)

SEQ ID NO: 5445 - DNA, 1489 bp, Mesorhizobium sp. M4B.F.Ca.ET.058.02.1.1; identical to SEQ ID NO: 5437
  ref <308>: DATABASE ACCESSION NUMBER: NCBI ACCESSION: NZ_CP034450.1
  ref <309>: DATABASE ENTRY DATE: 2019-04-01
  ref <313>: RELEVANT RESIDUES IN SEQ ID NO: (1)..(1489)

SEQ ID NO: 5446 - DNA, 1489 bp, Mesorhizobium sp. M4B.F.Ca.ET.089.01.1.1; identical to SEQ ID NO: 5437
  ref <308>: DATABASE ACCESSION NUMBER: NCBI ACCESSION: NZ_RZOS01000011.1
  ref <309>: DATABASE ENTRY DATE: 2019-04-01
  ref <313>: RELEVANT RESIDUES IN SEQ ID NO: (1)..(1489)

SEQ ID NO: 5447 - DNA, 1489 bp, Mesorhizobium sp. M5C.F.Ca.IN.020.29.1.1; identical to SEQ ID NO: 5320
  ref <308>: DATABASE ACCESSION NUMBER: NCBI ACCESSION: NZ_RZSW01000050.1
  ref <309>: DATABASE ENTRY DATE: 2019-04-01
  ref <313>: RELEVANT RESIDUES IN SEQ ID NO: (1)..(1489)

SEQ ID NO: 5448 - DNA, 1489 bp, Mesorhizobium sp. M5C.F.Ca.IN.020.32.2.1; identical to SEQ ID NO: 5320
  ref <308>: DATABASE ACCESSION NUMBER: NCBI ACCESSION: NZ_RZSX01000057.1
  ref <309>: DATABASE ENTRY DATE: 2019-04-01
  ref <313>: RELEVANT RESIDUES IN SEQ ID NO: (1)..(1489)

SEQ ID NO: 5449 - DNA, 1489 bp, Mesorhizobium sp. M5C.F.Cr.IN.023.01.1.1; identical to SEQ ID NO: 5320
  ref <308>: DATABASE ACCESSION NUMBER: NCBI ACCESSION: NZ_RZSU01000194.1
  ref <309>: DATABASE ENTRY DATE: 2019-04-01
  ref <313>: RELEVANT RESIDUES IN SEQ ID NO: (1)..(1489)

SEQ ID NO: 5450 - DNA, 1489 bp, Mesorhizobium sp. M6A.T.Ce.TU.002.03.1.1
  ref <308>: DATABASE ACCESSION NUMBER: NCBI ACCESSION: NZ_RZTI01000133.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtctccagagatggagaccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5451 - DNA, 1490 bp, Mesorhizobium sp. M6A.T.Ce.TU.016.01.1.1
  ref <308>: DATABASE ACCESSION NUMBER: NCBI ACCESSION: NZ_RZTJ01000010.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagattttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtctccagagatggagaccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5452 - DNA, 1489 bp, Mesorhizobium sp. M6A.T.Cr.TU.014.01.1.1
  ref <308>: DATABASE ACCESSION NUMBER: NCBI ACCESSION: NZ_RZPG01000058.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtctccagagatgaagaccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5453 - DNA, 1489 bp, Mesorhizobium sp. M6A.T.Cr.TU.016.01.1.1; identical to SEQ ID NO: 5450
  ref <308>: DATABASE ACCESSION NUMBER: NCBI ACCESSION: NZ_CP034452.1
  ref <309>: DATABASE ENTRY DATE: 2019-04-01
  ref <313>: RELEVANT RESIDUES IN SEQ ID NO: (1)..(1489)

SEQ ID NO: 5454 - DNA, 1489 bp, Mesorhizobium sp. M6A.T.Cr.TU.017.01.1.1; identical to SEQ ID NO: 5450
  ref <308>: DATABASE ACCESSION NUMBER: NCBI ACCESSION: NZ_RZTA01000199.1
  ref <309>: DATABASE ENTRY DATE: 2019-04-01
  ref <313>: RELEVANT RESIDUES IN SEQ ID NO: (1)..(1489)

SEQ ID NO: 5455 - DNA, 1489 bp, Mesorhizobium sp. M7A.F.Ca.AU.001.01.1.1
  ref <308>: DATABASE ACCESSION NUMBER: NCBI ACCESSION: NZ_RZPF01000274.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5456 - DNA, 1489 bp, Mesorhizobium sp. M7A.F.Ca.AU.002.02.1.1; identical to SEQ ID NO: 5455
  ref <308>: DATABASE ACCESSION NUMBER: NCBI ACCESSION: NZ_RZPB01000242.1
  ref <309>: DATABASE ENTRY DATE: 2019-04-01
  ref <313>: RELEVANT RESIDUES IN SEQ ID NO: (1)..(1489)

SEQ ID NO: 5457 - DNA, 1489 bp, Mesorhizobium sp. M7A.F.Ca.AU.002.03.1.1; identical to SEQ ID NO: 5455
  ref <308>: DATABASE ACCESSION NUMBER: NCBI ACCESSION: NZ_RZPC01000063.1
  ref <309>: DATABASE ENTRY DATE: 2019-04-01
  ref <313>: RELEVANT RESIDUES IN SEQ ID NO: (1)..(1489)

SEQ ID NO: 5458 - DNA, 1489 bp, Mesorhizobium sp. M7A.F.Ca.AU.002.04.1.1; identical to SEQ ID NO: 5455
  ref <308>: DATABASE ACCESSION NUMBER: NCBI ACCESSION: NZ_RZPD01000096.1
  ref <309>: DATABASE ENTRY DATE: 2019-04-01
  ref <313>: RELEVANT RESIDUES IN SEQ ID NO: (1)..(1489)

SEQ ID NO: 5459 - DNA, 1489 bp, Mesorhizobium sp. M7A.F.Ca.AU.002.06.1.1; identical to SEQ ID NO: 5455
  ref <308>: DATABASE ACCESSION NUMBER: NCBI ACCESSION: NZ_RZPE01000204.1
  ref <309>: DATABASE ENTRY DATE: 2019-04-01
  ref <313>: RELEVANT RESIDUES IN SEQ ID NO: (1)..(1489)

SEQ ID NO: 5460 - DNA, 1489 bp, Mesorhizobium sp. M7A.F.Ca.CA.001.04.1.1; identical to SEQ ID NO: 5455
  ref <308>: DATABASE ACCESSION NUMBER: NCBI ACCESSION: NZ_RZQS01000109.1
  ref <309>: DATABASE ENTRY DATE: 2019-04-01
  ref <313>: RELEVANT RESIDUES IN SEQ ID NO: (1)..(1489)

SEQ ID NO: 5461 - DNA, 1489 bp, Mesorhizobium sp. M7A.F.Ca.CA.001.04.2.1; identical to SEQ ID NO: 5455
  ref <308>: DATABASE ACCESSION NUMBER: NCBI ACCESSION: NZ_RZQT01000006.1
  ref <309>: DATABASE ENTRY DATE: 2019-04-01
  ref <313>: RELEVANT RESIDUES IN SEQ ID NO: (1)..(1489)

SEQ ID NO: 5462 - DNA, 1489 bp, Mesorhizobium sp. M7A.F.Ca.CA.001.05.1.1; identical to SEQ ID NO: 5455
  ref <308>: DATABASE ACCESSION NUMBER: NCBI ACCESSION: NZ_RZQZ01000150.1
  ref <309>: DATABASE ENTRY DATE: 2019-04-01
  ref <313>: RELEVANT RESIDUES IN SEQ ID NO: (1)..(1489)

SEQ ID NO: 5463 - DNA, 1489 bp, Mesorhizobium sp. M7A.F.Ca.CA.001.06.1.1; identical to SEQ ID NO: 5455
  ref <308>: DATABASE ACCESSION NUMBER: NCBI ACCESSION: NZ_RZPM01000089.1
  ref <309>: DATABASE ENTRY DATE: 2019-04-01
  ref <313>: RELEVANT RESIDUES IN SEQ ID NO: (1)..(1489)

SEQ ID NO: 5464 - DNA, 1489 bp, Mesorhizobium sp. M7A.F.Ca.CA.001.07.2.1
  ref <308>: DATABASE ACCESSION NUMBER: NCBI ACCESSION: NZ_RZPO01000300.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5465 - DNA, 1489 bp, Mesorhizobium sp. M7A.F.Ca.CA.001.08.1.1; identical to SEQ ID NO: 5455
  ref <308>: DATABASE ACCESSION NUMBER: NCBI ACCESSION: NZ_RZPV01000205.1
  ref <309>: DATABASE ENTRY DATE: 2019-04-01
  ref <313>: RELEVANT RESIDUES IN SEQ ID NO: (1)..(1489)

SEQ ID NO: 5466 - DNA, 1489 bp, Mesorhizobium sp. M7A.F.Ca.CA.001.08.2.1; identical to SEQ ID NO: 5455
  ref <308>: DATABASE ACCESSION NUMBER: NCBI ACCESSION: NZ_RZPW01000170.1
  ref <309>: DATABASE ENTRY DATE: 2019-04-01
  ref <313>: RELEVANT RESIDUES IN SEQ ID NO: (1)..(1489)

SEQ ID NO: 5467 - DNA, 1489 bp, Mesorhizobium sp. M7A.F.Ca.CA.001.09.1.1; identical to SEQ ID NO: 5455
  ref <308>: DATABASE ACCESSION NUMBER: NCBI ACCESSION: NZ_RZQW01000026.1
  ref <309>: DATABASE ENTRY DATE: 2019-04-01
  ref <313>: RELEVANT RESIDUES IN SEQ ID NO: (1)..(1489)

SEQ ID NO: 5468 - DNA, 1489 bp, Mesorhizobium sp. M7A.F.Ca.CA.001.09.2.1; identical to SEQ ID NO: 5455
  ref <308>: DATABASE ACCESSION NUMBER: NCBI ACCESSION: NZ_RZQX01000078.1
  ref <309>: DATABASE ENTRY DATE: 2019-04-01
  ref <313>: RELEVANT RESIDUES IN SEQ ID NO: (1)..(1489)

SEQ ID NO: 5469 - DNA, 1489 bp, Mesorhizobium sp. M7A.F.Ca.CA.001.10.2.1; identical to SEQ ID NO: 5464
  ref <308>: DATABASE ACCESSION NUMBER: NCBI ACCESSION: NZ_RZQY01000138.1
  ref <309>: DATABASE ENTRY DATE: 2019-04-01
  ref <313>: RELEVANT RESIDUES IN SEQ ID NO: (1)..(1489)

SEQ ID NO: 5470 - DNA, 1489 bp, Mesorhizobium sp. M7A.F.Ca.CA.001.11.2.1; identical to SEQ ID NO: 5455
  ref <308>: DATABASE ACCESSION NUMBER: NCBI ACCESSION: NZ_RZPX01000074.1
  ref <309>: DATABASE ENTRY DATE: 2019-04-01
  ref <313>: RELEVANT RESIDUES IN SEQ ID NO: (1)..(1489)

SEQ ID NO: 5471 - DNA, 1489 bp, Mesorhizobium sp. M7A.F.Ca.CA.001.12.1.1; identical to SEQ ID NO: 5464
  ref <308>: DATABASE ACCESSION NUMBER: NCBI ACCESSION: NZ_RZRC01000294.1
  ref <309>: DATABASE ENTRY DATE: 2019-04-01
  ref <313>: RELEVANT RESIDUES IN SEQ ID NO: (1)..(1489)

SEQ ID NO: 5472 - DNA, 1489 bp, Mesorhizobium sp. M7A.F.Ca.CA.001.12.2.1; identical to SEQ ID NO: 5455
  ref <308>: DATABASE ACCESSION NUMBER: NCBI ACCESSION: NZ_RZRD01000181.1
  ref <309>: DATABASE ENTRY DATE: 2019-04-01
  ref <313>: RELEVANT RESIDUES IN SEQ ID NO: (1)..(1489)

SEQ ID NO: 5473 - DNA, 1489 bp, Mesorhizobium sp. M7A.F.Ca.CA.001.13.1.1; identical to SEQ ID NO: 5455
  ref <308>: DATABASE ACCESSION NUMBER: NCBI ACCESSION: NZ_RZRG01000081.1
  ref <309>: DATABASE ENTRY DATE: 2019-04-01
  ref <313>: RELEVANT RESIDUES IN SEQ ID NO: (1)..(1489)

SEQ ID NO: 5474 - DNA, 1489 bp, Mesorhizobium sp. M7A.F.Ca.CA.001.14.1.1; identical to SEQ ID NO: 5455
  ref <308>: DATABASE ACCESSION NUMBER: NCBI ACCESSION: NZ_RZQK01000040.1
  ref <309>: DATABASE ENTRY DATE: 2019-04-01
  ref <313>: RELEVANT RESIDUES IN SEQ ID NO: (1)..(1489)

SEQ ID NO: 5475 - DNA, 1489 bp, Mesorhizobium sp. M7A.F.Ca.CA.001.15.1.1; identical to SEQ ID NO: 5455
  ref <308>: DATABASE ACCESSION NUMBER: NCBI ACCESSION: NZ_RZQR01000076.1
  ref <309>: DATABASE ENTRY DATE: 2019-04-01
  ref <313>: RELEVANT RESIDUES IN SEQ ID NO: (1)..(1489)

SEQ ID NO: 5476 - DNA, 1489 bp, Mesorhizobium sp. M7A.F.Ca.CA.001.16.1.1; identical to SEQ ID NO: 5455
  ref <308>: DATABASE ACCESSION NUMBER: NCBI ACCESSION: NZ_RZPN01000016.1
  ref <309>: DATABASE ENTRY DATE: 2019-04-01
  ref <313>: RELEVANT RESIDUES IN SEQ ID NO: (1)..(1489)

SEQ ID NO: 5477 - DNA, 1489 bp, Mesorhizobium sp. M7A.F.Ca.CA.002.03.1.1; identical to SEQ ID NO: 5455
  ref <308>: DATABASE ACCESSION NUMBER: NCBI ACCESSION: NZ_RZPJ01000054.1
  ref <309>: DATABASE ENTRY DATE: 2019-04-01
  ref <313>: RELEVANT RESIDUES IN SEQ ID NO: (1)..(1489)

SEQ ID NO: 5478 - DNA, 1489 bp, Mesorhizobium sp. M7A.F.Ca.CA.002.03.2.1; identical to SEQ ID NO: 5455
  ref <308>: DATABASE ACCESSION NUMBER: NCBI ACCESSION: NZ_RZPK01000106.1
  ref <309>: DATABASE ENTRY DATE: 2019-04-01
  ref <313>: RELEVANT RESIDUES IN SEQ ID NO: (1)..(1489)

SEQ ID NO: 5479 - DNA, 1489 bp, Mesorhizobium sp. M7A.F.Ca.CA.002.04.1.1; identical to SEQ ID NO: 5455
  ref <308>: DATABASE ACCESSION NUMBER: NCBI ACCESSION: NZ_RZPL01000046.1
  ref <309>: DATABASE ENTRY DATE: 2019-04-01
  ref <313>: RELEVANT RESIDUES IN SEQ ID NO: (1)..(1489)

SEQ ID NO: 5480 - DNA, 1489 bp, Mesorhizobium sp. M7A.F.Ca.CA.002.05.1.1; identical to SEQ ID NO: 5464
  ref <308>: DATABASE ACCESSION NUMBER: NCBI ACCESSION: NZ_RZQI01000201.1
  ref <309>: DATABASE ENTRY DATE: 2019-04-01
  ref <313>: RELEVANT RESIDUES IN SEQ ID NO: (1)..(1489)

SEQ ID NO: 5481 - DNA, 1489 bp, Mesorhizobium sp. M7A.F.Ca.CA.002.06.1.1; identical to SEQ ID NO: 5455
  ref <308>: DATABASE ACCESSION NUMBER: NCBI ACCESSION: NZ_RZQJ01000059.1
  ref <309>: DATABASE ENTRY DATE: 2019-04-01
  ref <313>: RELEVANT RESIDUES IN SEQ ID NO: (1)..(1489)

SEQ ID NO: 5482 - DNA, 1489 bp, Mesorhizobium sp. M7A.F.Ca.CA.002.07.1.1; identical to SEQ ID NO: 5455
  ref <308>: DATABASE ACCESSION NUMBER: NCBI ACCESSION: NZ_RZRB01000090.1
  ref <309>: DATABASE ENTRY DATE: 2019-04-01
  ref <313>: RELEVANT RESIDUES IN SEQ ID NO: (1)..(1489)

SEQ ID NO: 5483 - DNA, 1489 bp, Mesorhizobium sp. M7A.F.Ca.CA.002.09.1.1; identical to SEQ ID NO: 5455
  ref <308>: DATABASE ACCESSION NUMBER: NCBI ACCESSION: NZ_RZRR01000022.1
  ref <309>: DATABASE ENTRY DATE: 2019-04-01
  ref <313>: RELEVANT RESIDUES IN SEQ ID NO: (1)..(1489)

SEQ ID NO: 5484 - DNA, 1489 bp, Mesorhizobium sp. M7A.F.Ca.CA.002.10.1.1; identical to SEQ ID NO: 5455
  ref <308>: DATABASE ACCESSION NUMBER: NCBI ACCESSION: NZ_RZPP01000038.1
  ref <309>: DATABASE ENTRY DATE: 2019-04-01
  ref <313>: RELEVANT RESIDUES IN SEQ ID NO: (1)..(1489)

SEQ ID NO: 5485 - DNA, 1489 bp, Mesorhizobium sp. M7A.F.Ca.CA.002.11.2.1; identical to SEQ ID NO: 5455
  ref <308>: DATABASE ACCESSION NUMBER: NCBI ACCESSION: NZ_RZRM01000006.1
  ref <309>: DATABASE ENTRY DATE: 2019-04-01
  ref <313>: RELEVANT RESIDUES IN SEQ ID NO: (1)..(1489)

SEQ ID NO: 5486 - DNA, 1489 bp, Mesorhizobium sp. M7A.F.Ca.CA.002.12.1.1
  ref <308>: DATABASE ACCESSION NUMBER: NCBI ACCESSION: NZ_RZRN01000005.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcgtgatccagccatgcggcgtgagtgatgaaggcgctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5487 - DNA, 1489 bp, Mesorhizobium sp. M7A.F.Ca.CA.002.14.1.2
  ref <308>: DATABASE ACCESSION NUMBER: NCBI ACCESSION: NZ_RZRS01000039.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcaggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5488 - DNA, 1489 bp, Mesorhizobium sp. M7A.F.Ca.CA.002.15.1.1; identical to SEQ ID NO: 5455
  ref <308>: DATABASE ACCESSION NUMBER: NCBI ACCESSION: NZ_RZQV01000010.1
  ref <309>: DATABASE ENTRY DATE: 2019-04-01
  ref <313>: RELEVANT RESIDUES IN SEQ ID NO: (1)..(1489)

SEQ ID NO: 5489 - DNA, 1489 bp, Mesorhizobium sp. M7A.F.Ca.CA.002.15.2.1; identical to SEQ ID NO: 5455
  ref <308>: DATABASE ACCESSION NUMBER: NCBI ACCESSION: NZ_RZPI01000218.1
  ref <309>: DATABASE ENTRY DATE: 2019-04-01
  ref <313>: RELEVANT RESIDUES IN SEQ ID NO: (1)..(1489)

SEQ ID NO: 5490 - DNA, 1489 bp, Mesorhizobium sp. M7A.F.Ca.CA.003.01.2.1; identical to SEQ ID NO: 5455
  ref <308>: DATABASE ACCESSION NUMBER: NCBI ACCESSION: NZ_RZRA01000011.1
  ref <309>: DATABASE ENTRY DATE: 2019-04-01
  ref <313>: RELEVANT RESIDUES IN SEQ ID NO: (1)..(1489)

SEQ ID NO: 5491 - DNA, 1489 bp, Mesorhizobium sp. M7A.F.Ca.CA.004.01.1.1; identical to SEQ ID NO: 5464
  ref <308>: DATABASE ACCESSION NUMBER: NCBI ACCESSION: NZ_RZPT01000201.1
  ref <309>: DATABASE ENTRY DATE: 2019-04-01
  ref <313>: RELEVANT RESIDUES IN SEQ ID NO: (1)..(1489)

SEQ ID NO: 5492 - DNA, 1489 bp, Mesorhizobium sp. M7A.F.Ca.CA.004.02.1.1; identical to SEQ ID NO: 5464
  ref <308>: DATABASE ACCESSION NUMBER: NCBI ACCESSION: NZ_RZPU01000251.1
  ref <309>: DATABASE ENTRY DATE: 2019-04-01
  ref <313>: RELEVANT RESIDUES IN SEQ ID NO: (1)..(1489)

SEQ ID NO: 5493 - DNA, 1489 bp, Mesorhizobium sp. M7A.F.Ca.CA.004.04.1.1; identical to SEQ ID NO: 5464
  ref <308>: DATABASE ACCESSION NUMBER: NCBI ACCESSION: NZ_RZRL01000103.1
  ref <309>: DATABASE ENTRY DATE: 2019-04-01
  ref <313>: RELEVANT RESIDUES IN SEQ ID NO: (1)..(1489)

SEQ ID NO: 5494 - DNA, 1489 bp, Mesorhizobium sp. M7A.F.Ca.CA.004.04.2.1; identical to SEQ ID NO: 5464
  ref <308>: DATABASE ACCESSION NUMBER: NCBI ACCESSION: NZ_RZPH01000097.1
  ref <309>: DATABASE ENTRY DATE: 2019-04-01
  ref <313>: RELEVANT RESIDUES IN SEQ ID NO: (1)..(1489)

SEQ ID NO: 5495 - DNA, 1489 bp, Mesorhizobium sp. M7A.F.Ca.CA.004.05.2.1; identical to SEQ ID NO: 5464
  ref <308>: DATABASE ACCESSION NUMBER: NCBI ACCESSION: NZ_RZQU01000222.1
  ref <309>: DATABASE ENTRY DATE: 2019-04-01
  ref <313>: RELEVANT RESIDUES IN SEQ ID NO: (1)..(1489)

SEQ ID NO: 5496 - DNA, 1489 bp, Mesorhizobium sp. M7A.F.Ca.CA.004.06.1.1; identical to SEQ ID NO: 5464
  ref <308>: DATABASE ACCESSION NUMBER: NCBI ACCESSION: NZ_RZPQ01000141.1
  ref <309>: DATABASE ENTRY DATE: 2019-04-01
  ref <313>: RELEVANT RESIDUES IN SEQ ID NO: (1)..(1489)

SEQ ID NO: 5497 - DNA, 1489 bp, Mesorhizobium sp. M7A.F.Ca.CA.004.06.2.1; identical to SEQ ID NO: 5464
  ref <308>: DATABASE ACCESSION NUMBER: NCBI ACCESSION: NZ_RZPR01000210.1
  ref <309>: DATABASE ENTRY DATE: 2019-04-01
  ref <313>: RELEVANT RESIDUES IN SEQ ID NO: (1)..(1489)

SEQ ID NO: 5498 - DNA, 1489 bp, Mesorhizobium sp. M7A.F.Ca.CA.004.07.1.1; identical to SEQ ID NO: 5464
  ref <308>: DATABASE ACCESSION NUMBER: NCBI ACCESSION: NZ_RZPS01000122.1
  ref <309>: DATABASE ENTRY DATE: 2019-04-01
  ref <313>: RELEVANT RESIDUES IN SEQ ID NO: (1)..(1489)

SEQ ID NO: 5499 - DNA, 1489 bp, Mesorhizobium sp. M7A.F.Ca.CA.004.08.1.1; identical to SEQ ID NO: 5464
  ref <308>: DATABASE ACCESSION NUMBER: NCBI ACCESSION: NZ_RZRI01000292.1
  ref <309>: DATABASE ENTRY DATE: 2019-04-01
  ref <313>: RELEVANT RESIDUES IN SEQ ID NO: (1)..(1489)

SEQ ID NO: 5500 - DNA, 1489 bp, Mesorhizobium sp. M7A.F.Ca.CA.004.08.2.1; identical to SEQ ID NO: 5464
  ref <308>: DATABASE ACCESSION NUMBER: NCBI ACCESSION: NZ_RZRJ01000121.1
  ref <309>: DATABASE ENTRY DATE: 2019-04-01
  ref <313>: RELEVANT RESIDUES IN SEQ ID NO: (1)..(1489)

SEQ ID NO: 5501 - DNA, 1489 bp, Mesorhizobium sp. M7A.F.Ca.CA.004.09.1.2; identical to SEQ ID NO: 5464
  ref <308>: DATABASE ACCESSION NUMBER: NCBI ACCESSION: NZ_RZPZ01000095.1
  ref <309>: DATABASE ENTRY DATE: 2019-04-01
  ref <313>: RELEVANT RESIDUES IN SEQ ID NO: (1)..(1489)

SEQ ID NO: 5502 - DNA, 1489 bp, Mesorhizobium sp. M7A.F.Ca.CA.004.10.1.1; identical to SEQ ID NO: 5464
  ref <308>: DATABASE ACCESSION NUMBER: NCBI ACCESSION: NZ_RZQB01000100.1
  ref <309>: DATABASE ENTRY DATE: 2019-04-01
  ref <313>: RELEVANT RESIDUES IN SEQ ID NO: (1)..(1489)

SEQ ID NO: 5503 - DNA, 1489 bp, Mesorhizobium sp. M7A.F.Ca.CA.004.11.1.1; identical to SEQ ID NO: 5464
  ref <308>: DATABASE ACCESSION NUMBER: NCBI ACCESSION: NZ_RZQC01000373.1
  ref <309>: DATABASE ENTRY DATE: 2019-04-01
  ref <313>: RELEVANT RESIDUES IN SEQ ID NO: (1)..(1489)

SEQ ID NO: 5504 - DNA, 1489 bp, Mesorhizobium sp. M7A.F.Ca.CA.004.11.2.1; identical to SEQ ID NO: 5464
  ref <308>: DATABASE ACCESSION NUMBER: NCBI ACCESSION: NZ_RZQD01000012.1
  ref <309>: DATABASE ENTRY DATE: 2019-04-01
  ref <313>: RELEVANT RESIDUES IN SEQ ID NO: (1)..(1489)

SEQ ID NO: 5505 - DNA, 1489 bp, Mesorhizobium sp. M7A.F.Ca.CA.004.12.1.1; identical to SEQ ID NO: 5464
  ref <308>: DATABASE ACCESSION NUMBER: NCBI ACCESSION: NZ_RZRK01000083.1
  ref <309>: DATABASE ENTRY DATE: 2019-04-01
  ref <313>: RELEVANT RESIDUES IN SEQ ID NO: (1)..(1489)

SEQ ID NO: 5506 - DNA, 1489 bp, Mesorhizobium sp. M7A.F.Ca.ET.027.02.1.1; identical to SEQ ID NO: 5464
  ref <308>: DATABASE ACCESSION NUMBER: NCBI ACCESSION: NZ_RZOL01000013.1
  ref <309>: DATABASE ENTRY DATE: 2019-04-01
  ref <313>: RELEVANT RESIDUES IN SEQ ID NO: (1)..(1489)

SEQ ID NO: 5507 - DNA, 1489 bp, Mesorhizobium sp. M7A.F.Ca.ET.027.03.2.1; identical to SEQ ID NO: 5464
  ref <308>: DATABASE ACCESSION NUMBER: NCBI ACCESSION: NZ_RZOM01000036.1
  ref <309>: DATABASE ENTRY DATE: 2019-04-01
  ref <313>: RELEVANT RESIDUES IN SEQ ID NO: (1)..(1489)

SEQ ID NO: 5508 - DNA, 1489 bp, Mesorhizobium sp. M7A.F.Ca.MR.148.00.0.0; identical to SEQ ID NO: 5464
  ref <308>: DATABASE ACCESSION NUMBER: NCBI ACCESSION: NZ_RZTB01000190.1
  ref <309>: DATABASE ENTRY DATE: 2019-04-01
  ref <313>: RELEVANT RESIDUES IN SEQ ID NO: (1)..(1489)

SEQ ID NO: 5509 - DNA, 1489 bp, Mesorhizobium sp. M7A.F.Ca.MR.176.00.0.0; identical to SEQ ID NO: 5464
  ref <308>: DATABASE ACCESSION NUMBER: NCBI ACCESSION: NZ_RZTC01000158.1
  ref <309>: DATABASE ENTRY DATE: 2019-04-01
  ref <313>: RELEVANT RESIDUES IN SEQ ID NO: (1)..(1489)

SEQ ID NO: 5510 - DNA, 1489 bp, Mesorhizobium sp. M7A.F.Ca.MR.245.00.0.0; identical to SEQ ID NO: 5464
  ref <308>: DATABASE ACCESSION NUMBER: NCBI ACCESSION: NZ_RZTE01000077.1
  ref <309>: DATABASE ENTRY DATE: 2019-04-01
  ref <313>: RELEVANT RESIDUES IN SEQ ID NO: (1)..(1489)

SEQ ID NO: 5511 - DNA, 821 bp, Mesorhizobium sp. M7A.F.Ca.MR.362.00.0.0
  ref <308>: DATABASE ACCESSION NUMBER: NCBI ACCESSION: NZ_RZTF01000804.1
  ref <309>: DATABASE ENTRY DATE: 2019-04-01
  ref <313>: RELEVANT RESIDUES IN SEQ ID NO: (1)..(821)
ttatcggagagtttgatcctggctcaggacgaacgctggcggcgtgcctaatacatgcaagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgtgagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaac

SEQ ID NO: 5512 - DNA, 1489 bp, Mesorhizobium sp. M7A.F.Ca.US.001.02.1.1; identical to SEQ ID NO: 5455
  ref <308>: DATABASE ACCESSION NUMBER: NCBI ACCESSION: NZ_RZQH01000165.1
  ref <309>: DATABASE ENTRY DATE: 2019-04-01
  ref <313>: RELEVANT RESIDUES IN SEQ ID NO: (1)..(1489)

SEQ ID NO: 5513 - DNA, 1489 bp, Mesorhizobium sp. M7A.F.Ca.US.001.04.1.1; identical to SEQ ID NO: 5455
  ref <308>: DATABASE ACCESSION NUMBER: NCBI ACCESSION: NZ_RZRE01000084.1
  ref <309>: DATABASE ENTRY DATE: 2019-04-01
  ref <313>: RELEVANT RESIDUES IN SEQ ID NO: (1)..(1489)

SEQ ID NO: 5514 - DNA, 1489 bp, Mesorhizobium sp. M7A.F.Ca.US.001.04.2.1; identical to SEQ ID NO: 5455
  ref <308>: DATABASE ACCESSION NUMBER: NCBI ACCESSION: NZ_RZRF01000015.1
  ref <309>: DATABASE ENTRY DATE: 2019-04-01
  ref <313>: RELEVANT RESIDUES IN SEQ ID NO: (1)..(1489)

SEQ ID NO: 5515 - DNA, 1489 bp, Mesorhizobium sp. M7A.F.Ca.US.002.01.1.1; identical to SEQ ID NO: 5455
  ref <308>: DATABASE ACCESSION NUMBER: NCBI ACCESSION: NZ_RZQE01000193.1
  ref <309>: DATABASE ENTRY DATE: 2019-04-01
  ref <313>: RELEVANT RESIDUES IN SEQ ID NO: (1)..(1489)

SEQ ID NO: 5516 - DNA, 1489 bp, Mesorhizobium sp. M7A.F.Ca.US.003.02.1.1; identical to SEQ ID NO: 5455
  ref <308>: DATABASE ACCESSION NUMBER: NCBI ACCESSION: NZ_RZQO01000313.1
  ref <309>: DATABASE ENTRY DATE: 2019-04-01
  ref <313>: RELEVANT RESIDUES IN SEQ ID NO: (1)..(1489)

SEQ ID NO: 5517 - DNA, 1489 bp, Mesorhizobium sp. M7A.F.Ca.US.005.03.1.1
  ref <308>: DATABASE ACCESSION NUMBER: NCBI ACCESSION: NZ_RZRO01000032.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgcctcgcaaggggagcggcagacgggtgagtaacgcgtgggaatctacccatctctacggaacaactccgggaaactggagcgaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5518 - DNA, 1489 bp, Mesorhizobium sp. M7A.F.Ca.US.005.03.2.1
  ref <308>: DATABASE ACCESSION NUMBER: NCBI ACCESSION: NZ_RZRP01000019.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggagcctgcggctggatcacctcctttctaag

SEQ ID NO: 5519 - DNA, 1489 bp, Mesorhizobium sp. M7A.F.Ca.US.006.01.1.1
  ref <308>: DATABASE ACCESSION NUMBER: NCBI ACCESSION: NZ_RZQL01000098.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5520 - DNA, 1489 bp, Mesorhizobium sp. M7A.F.Ca.US.006.01.2.1; identical to SEQ ID NO: 5464
  ref <308>: DATABASE ACCESSION NUMBER: NCBI ACCESSION: NZ_RZQM01000255.1
  ref <309>: DATABASE ENTRY DATE: 2019-04-01
  ref <313>: RELEVANT RESIDUES IN SEQ ID NO: (1)..(1489)

SEQ ID NO: 5521 - DNA, 1489 bp, Mesorhizobium sp. M7A.F.Ca.US.006.04.2.1; identical to SEQ ID NO: 5455
  ref <308>: DATABASE ACCESSION NUMBER: NCBI ACCESSION: NZ_RZQA01000056.1
  ref <309>: DATABASE ENTRY DATE: 2019-04-01
  ref <313>: RELEVANT RESIDUES IN SEQ ID NO: (1)..(1489)

SEQ ID NO: 5522 - DNA, 1489 bp, Mesorhizobium sp. M7A.F.Ca.US.007.01.1.1; identical to SEQ ID NO: 5455
  ref <308>: DATABASE ACCESSION NUMBER: NCBI ACCESSION: NZ_RZQQ01000010.1
  ref <309>: DATABASE ENTRY DATE: 2019-04-01
  ref <313>: RELEVANT RESIDUES IN SEQ ID NO: (1)..(1489)

SEQ ID NO: 5523 - DNA, 1489 bp, Mesorhizobium sp. M7A.F.Ca.US.007.01.2.1; identical to SEQ ID NO: 5455
  ref <308>: DATABASE ACCESSION NUMBER: NCBI ACCESSION: NZ_RZQP01000074.1
  ref <309>: DATABASE ENTRY DATE: 2019-04-01
  ref <313>: RELEVANT RESIDUES IN SEQ ID NO: (1)..(1489)

SEQ ID NO: 5524 - DNA, 1489 bp, Mesorhizobium sp. M7A.F.Ca.US.008.03.1.1
  ref <308>: DATABASE ACCESSION NUMBER: NCBI ACCESSION: NZ_RZRU01000014.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5525 - DNA, 1489 bp, Mesorhizobium sp. M7A.F.Ca.US.010.02.1.1
  ref <308>: DATABASE ACCESSION NUMBER: NCBI ACCESSION: NZ_RZRV01000018.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgggacacgtcccaaactcctacgggaggcagcagtggggaatattggacaatgggcgcaagcctgatccagccatgccgcgtgagtgatgaaggcactagggttgtaaagctctttcaacggtgaagataatgacggtaaccgtagaagaagccccggctaactgcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5526 - DNA, 1489 bp, Mesorhizobium sp. M7A.F.Ca.US.011.01.1.1
  ref <308>: DATABASE ACCESSION NUMBER: NCBI ACCESSION: NZ_RZRT01000012.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5527 - DNA, 1489 bp, Mesorhizobium sp. M7A.F.Ca.US.014.04.1.1; identical to SEQ ID NO: 5455
  ref <308>: DATABASE ACCESSION NUMBER: NCBI ACCESSION: NZ_RZRW01000050.1
  ref <309>: DATABASE ENTRY DATE: 2019-04-01
  ref <313>: RELEVANT RESIDUES IN SEQ ID NO: (1)..(1489)

SEQ ID NO: 5528 - DNA, 1489 bp, Mesorhizobium sp. M7A.F.Ce.TU.012.03.2.1; identical to SEQ ID NO: 5464
  ref <308>: DATABASE ACCESSION NUMBER: NCBI ACCESSION: NZ_CP034779.1
  ref <309>: DATABASE ENTRY DATE: 2019-04-01
  ref <313>: RELEVANT RESIDUES IN SEQ ID NO: (1)..(1489)

SEQ ID NO: 5529 - DNA, 1489 bp, Mesorhizobium sp. M7A.T.Ca.TU.009.02.1.1; identical to SEQ ID NO: 5464
  ref <308>: DATABASE ACCESSION NUMBER: NCBI ACCESSION: NZ_RZTR01000225.1
  ref <309>: DATABASE ENTRY DATE: 2019-04-01
  ref <313>: RELEVANT RESIDUES IN SEQ ID NO: (1)..(1489)

SEQ ID NO: 5530 - DNA, 1489 bp, Mesorhizobium sp. M7A.T.Ca.US.000.02.1.1; identical to SEQ ID NO: 5464
  ref <308>: DATABASE ACCESSION NUMBER: NCBI ACCESSION: NZ_RZTS01000228.1
  ref <309>: DATABASE ENTRY DATE: 2019-04-01
  ref <313>: RELEVANT RESIDUES IN SEQ ID NO: (1)..(1489)

SEQ ID NO: 5531 - DNA, 1489 bp, Mesorhizobium sp. M7A.T.Ca.US.000.02.2.1; identical to SEQ ID NO: 5464
  ref <308>: DATABASE ACCESSION NUMBER: NCBI ACCESSION: NZ_RZTT01000008.1
  ref <309>: DATABASE ENTRY DATE: 2019-04-01
  ref <313>: RELEVANT RESIDUES IN SEQ ID NO: (1)..(1489)

SEQ ID NO: 5532 - DNA, 1489 bp, Mesorhizobium sp. M7D.F.Ca.US.004.01.2.1
  ref <308>: DATABASE ACCESSION NUMBER: NCBI ACCESSION: NZ_RZRQ01000283.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5533 - DNA, 1489 bp, Mesorhizobium sp. M7D.F.Ca.US.004.03.1.1; identical to SEQ ID NO: 5532
  ref <308>: DATABASE ACCESSION NUMBER: NCBI ACCESSION: NZ_RZQG01000187.1
  ref <309>: DATABASE ENTRY DATE: 2019-04-01
  ref <313>: RELEVANT RESIDUES IN SEQ ID NO: (1)..(1489)

SEQ ID NO: 5534 - DNA, 1489 bp, Mesorhizobium sp. M7D.F.Ca.US.005.01.1.1; identical to SEQ ID NO: 5532
  ref <308>: DATABASE ACCESSION NUMBER: NCBI ACCESSION: NZ_CP034453.1
  ref <309>: DATABASE ENTRY DATE: 2019-04-01
  ref <313>: RELEVANT RESIDUES IN SEQ ID NO: (1)..(1489)

SEQ ID NO: 5535 - DNA, 1489 bp, Mesorhizobium sp. M8A.F.Ca.ET.021.01.1.1; identical to SEQ ID NO: 5388
  ref <308>: DATABASE ACCESSION NUMBER: NCBI ACCESSION: NZ_RZSJ01000269.1
  ref <309>: DATABASE ENTRY DATE: 2019-04-01
  ref <313>: RELEVANT RESIDUES IN SEQ ID NO: (1)..(1489)

SEQ ID NO: 5536 - DNA, 1489 bp, Mesorhizobium sp. M9A.F.Ca.ET.002.03.1.2
  ref <308>: DATABASE ACCESSION NUMBER: NCBI ACCESSION: NZ_CP034443.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgctgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5537 - DNA, 1493 bp, Mesorhizobium sp. NBIMC P2-C1
  ref <308>: DATABASE ACCESSION NUMBER: NCBI ACCESSION: NZ_AVBN01000018.1
  ref <309>: DATABASE ENTRY DATE: 2019-04-01
  ref <313>: RELEVANT RESIDUES IN SEQ ID NO: (1)..(1493)
ttaaacatgagagtttgatcctggctcagaacgaacgctggcggcaggcttaacacatgcaagtcgagcgccccgcaaggggagcggcagacgggtgagtaacgcgtgggaatctacccatcactacggaacaactccgggaaactggagctaataccgtatacgtccttcgggagaaagatttatcggtgatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggatttactgggcgtaaagcgcacgtaggcggattgttaagttaggggtgaaatcccagggctcaaccctggaactgcctttaatactggcaatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgctgtaaacgatggaagctagccgtcggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggcctagagagatttaggccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5538 - DNA, 1493 bp, Mesorhizobium sp. NBIMC P2-C2; identical to SEQ ID NO: 5537
  ref <308>: DATABASE ACCESSION NUMBER: NCBI ACCESSION: NZ_AVBO01000034.1
  ref <309>: DATABASE ENTRY DATE: 2019-04-01
  ref <313>: RELEVANT RESIDUES IN SEQ ID NO: (1)..(1493)

SEQ ID NO: 5539 - DNA, 1493 bp, Mesorhizobium sp. NBIMC P2-C3; identical to SEQ ID NO: 5537
  ref <308>: DATABASE ACCESSION NUMBER: NCBI ACCESSION: NZ_AVBP01000032.1
  ref <309>: DATABASE ENTRY DATE: 2019-04-01
  ref <313>: RELEVANT RESIDUES IN SEQ ID NO: (1)..(1493)

SEQ ID NO: 5540 - DNA, 1493 bp, Mesorhizobium sp. NBIMC P2-C4; identical to SEQ ID NO: 5537
  ref <308>: DATABASE ACCESSION NUMBER: NCBI ACCESSION: NZ_AVBQ01000047.1
  ref <309>: DATABASE ENTRY DATE: 2019-04-01
  ref <313>: RELEVANT RESIDUES IN SEQ ID NO: (1)..(1493)

SEQ ID NO: 5541 - DNA, 255 bp, Mesorhizobium sp. ORS 3428
  ref <308>: DATABASE ACCESSION NUMBER: NCBI ACCESSION: NZ_MDFL01000140.1
  ref <309>: DATABASE ENTRY DATE: 2019-04-01
  ref <313>: RELEVANT RESIDUES IN SEQ ID NO: (1)..(255)
aacttgagagtttgatcctggctcagaacgaacgctggcggcaggcttaacacatgcaagtcgagcgcgtagcaatacgagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagc

SEQ ID NO: 5542 - DNA, 1489 bp, Mesorhizobium sp. Pch-S
  ref <308>: DATABASE ACCESSION NUMBER: NCBI ACCESSION: NZ_CP029562.1
  ref <309>: DATABASE ENTRY DATE: 2019-04-01
  ref <313>: RELEVANT RESIDUES IN SEQ ID NO: (1)..(1489)
aacatgagagtttgatcctggctcagaacgaacgctggcggcaggcttaacacatgcaagtcgagcgccccgcaaggggagcggcagacgggtgagtaacgcgtgggaatctacccatcactacggaacaactccgggaaactggagctaataccgtatacgtccttcgggagaaagatttatcggtgatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggatttactgggcgtaaagcgcacgtaggcggactattaagtcaggggtgaaatcccggggctcaaccccggaactgcctttgatactggtagtctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaggtttacctgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5543 - DNA, 1489 bp, Mesorhizobium sp. Primo-A
  ref <308>: DATABASE ACCESSION NUMBER: NCBI ACCESSION: NZ_RZTG01000010.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaagatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5544 - DNA, 1489 bp, Mesorhizobium sp. Primo-B; identical to SEQ ID NO: 5455
  ref <308>: DATABASE ACCESSION NUMBER: NCBI ACCESSION: NZ_RZTH01000012.1
  ref <309>: DATABASE ENTRY DATE: 2019-04-01
  ref <313>: RELEVANT RESIDUES IN SEQ ID NO: (1)..(1489)

SEQ ID NO: 5545 - DNA, 1490 bp, Mesorhizobium sp. Root102
  ref <308>: DATABASE ACCESSION NUMBER: NCBI ACCESSION: NZ_LMCP01000046.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5546 - DNA, 1492 bp, Mesorhizobium sp. Root1471
  ref <308>: DATABASE ACCESSION NUMBER: NCBI ACCESSION: NZ_LMFW01000001.1
  ref <309>: DATABASE ENTRY DATE: 2019-04-01
  ref <313>: RELEVANT RESIDUES IN SEQ ID NO: (1)..(1492)
aacatgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagttaggggtgaaatcccagagctcaactctggaactgcctttaatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgcgccaacccgcaagggaagcaggcgaccacggtagggtcagcgactggggtgaagtcgtaacaaggtagccgtaggggaacctgcggctggatcacctcctttctaagg

SEQ ID NO: 5547 - DNA, 1496 bp, Mesorhizobium sp. Root157
  ref <308>: DATABASE ACCESSION NUMBER: NCBI ACCESSION: NZ_LMGJ01000036.1
  ref <309>: DATABASE ENTRY DATE: 2019-04-01
  ref <313>: RELEVANT RESIDUES IN SEQ ID NO: (1)..(1496)
attaaacttgagagtttgatcctggctcagaacgaacgctggcggcaggcttaacacatgcaagtcgagcgccccgcaaggggagcggcagacgggtgagtaacgcgtgggaatctacctatctctacggaataacccagggaaacttggactaataccgtatacgcccttcgggggaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagttaggggtgaaatcccggggctcaaccccggaactgcctttaatactgggtatctcgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccgatcgcggttaccagagatggtttccttcagttaggctggatcggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgccaacccgcaagggaagcaggcgaccacggtagggtcagcgactggggtgaagtcgtaacaaggtagccgtaggggaacctgcggctggatcacctcctttctaagg

SEQ ID NO: 5548 - DNA, 1490 bp, Mesorhizobium sp. Root172
  ref <308>: DATABASE ACCESSION NUMBER: NCBI ACCESSION: NZ_LMHP01000021.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5549 - DNA, 1490 bp, Mesorhizobium sp. Root552
  ref <308>: DATABASE ACCESSION NUMBER: NCBI ACCESSION: NZ_LMFV01000001.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaataacccagggaaacttggactaataccgtatacgtccttcgggagaaagatttatcggagatggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaactatgagagctagccgttggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggatcccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5550 - DNA, 1492 bp, Mesorhizobium sp. Root554; identical to SEQ ID NO: 5546
  ref <308>: DATABASE ACCESSION NUMBER: NCBI ACCESSION: NZ_LMGA01000001.1
  ref <309>: DATABASE ENTRY DATE: 2019-04-01
  ref <313>: RELEVANT RESIDUES IN SEQ ID NO: (1)..(1492)

SEQ ID NO: 5551 - DNA, 1490 bp, Mesorhizobium sp. Root695; identical to SEQ ID NO: 5545
  ref <308>: DATABASE ACCESSION NUMBER: NCBI ACCESSION: NZ_LMHO01000011.1
  ref <309>: DATABASE ENTRY DATE: 2019-04-01
  ref <313>: RELEVANT RESIDUES IN SEQ ID NO: (1)..(1490)

SEQ ID NO: 5552 - DNA, 625 bp, Mesorhizobium sp. SEMIA 3007
  ref <308>: DATABASE ACCESSION NUMBER: NCBI ACCESSION: NZ_MDLH01000002.1
  ref <309>: DATABASE ENTRY DATE: 2019-04-01
  ref <313>: RELEVANT RESIDUES IN SEQ ID NO: (1)..(625)
ccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaatt

SEQ ID NO: 5553 - DNA, 1490 bp, Mesorhizobium sp. SOD10; identical to SEQ ID NO: 5327
  ref <308>: DATABASE ACCESSION NUMBER: NCBI ACCESSION: NZ_CCNA01000059.1
  ref <309>: DATABASE ENTRY DATE: 2019-04-01
  ref <313>: RELEVANT RESIDUES IN SEQ ID NO: (1)..(1490)

SEQ ID NO: 5554 - DNA, 1490 bp, Mesorhizobium sp. STM 4661
  ref <308>: DATABASE ACCESSION NUMBER: NCBI ACCESSION: NZ_CAAF010000026.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgcctcgaaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5555 - DNA, 1493 bp, Mesorhizobium sp. UASWS1009; identical to SEQ ID NO: 5537
  ref <308>: DATABASE ACCESSION NUMBER: NCBI ACCESSION: NZ_MDEO01000014.1
  ref <309>: DATABASE ENTRY DATE: 2019-04-01
  ref <313>: RELEVANT RESIDUES IN SEQ ID NO: (1)..(1493)

SEQ ID NO: 5556 - DNA, 1490 bp, Mesorhizobium sp. URHA0056
  ref <308>: DATABASE ACCESSION NUMBER: NCBI ACCESSION: NZ_AUEL01000026.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttatggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccggggctcaaccccggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5557 - DNA, 1490 bp, Mesorhizobium sp. URHB0007; identical to SEQ ID NO: 5338
  ref <308>: DATABASE ACCESSION NUMBER: NCBI ACCESSION: NZ_JIAO01000019.1
  ref <309>: DATABASE ENTRY DATE: 2019-04-01
  ref <313>: RELEVANT RESIDUES IN SEQ ID NO: (1)..(1490)

SEQ ID NO: 5558 - DNA, 1490 bp, Mesorhizobium sp. URHC0008
  ref <308>: DATABASE ACCESSION NUMBER: NCBI ACCESSION: NZ_JIAP01000007.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgcctcgcaagaggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccagggctcaaccctggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5559 - DNA, 1490 bp, Mesorhizobium sp. WSM1293; identical to SEQ ID NO: 5319
  ref <308>: DATABASE ACCESSION NUMBER: NCBI ACCESSION: NZ_AZUV01000005.1
  ref <309>: DATABASE ENTRY DATE: 2019-04-01
  ref <313>: RELEVANT RESIDUES IN SEQ ID NO: (1)..(1490)

SEQ ID NO: 5560 - DNA, 1490 bp, Mesorhizobium sp. WSM1497; identical to SEQ ID NO: 5319
  ref <308>: DATABASE ACCESSION NUMBER: NCBI ACCESSION: NZ_CP021070.1
  ref <309>: DATABASE ENTRY DATE: 2019-04-01
  ref <313>: RELEVANT RESIDUES IN SEQ ID NO: (1)..(1490)

SEQ ID NO: 5561 - DNA, 1490 bp, Mesorhizobium sp. WSM2561; identical to SEQ ID NO: 5348
  ref <308>: DATABASE ACCESSION NUMBER: NCBI ACCESSION: NZ_AZUX01000014.1
  ref <309>: DATABASE ENTRY DATE: 2019-04-01
  ref <313>: RELEVANT RESIDUES IN SEQ ID NO: (1)..(1490)

SEQ ID NO: 5562 - DNA, 1490 bp, Mesorhizobium sp. WSM3224
  ref <308>: DATABASE ACCESSION NUMBER: NCBI ACCESSION: NZ_ATYO01000002.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatgggaaccttcagttcggctggaccggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5563 - DNA, 1490 bp, Mesorhizobium sp. WSM3626
  ref <308>: DATABASE ACCESSION NUMBER: NCBI ACCESSION: NZ_AZUY01000011.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttttggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagttaggggtgaaatcccggggctcaaccccggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatgagagctagccgtcggcaagtttacttgtcggtggcgcagctaacgcattaagctctccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggataccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 5564 - DNA, 1490 bp, Mesorhizobium sp. WSM3873; identical to SEQ ID NO: 5333
  ref <308>: DATABASE ACCESSION NUMBER: NCBI ACCESSION: NZ_LYTM01000003.1
  ref <309>: DATABASE ENTRY DATE: 2019-04-01
  ref <313>: RELEVANT RESIDUES IN SEQ ID NO: (1)..(1490)

SEQ ID NO: 5565 - DNA, 1489 bp, Mesorhizobium sp. YM1C-6-2
  ref <308>: DATABASE ACCESSION NUMBER: NCBI ACCESSION: NZ_RCIZ01000002.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacctatctctacggaataacccagggaaacttggactaataccgtatacgcccttcgggggaaagatttatcggagatggatgagcccgcgttggattagctagttggtggggtaatggcccaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattggtcagttaggggtgaaatcccggggctcaaccccggaactgcctttaatactgccaatctagagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaactatggaagctagccgtcggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggttacgagagatcgtatccttcagttcggctggaccggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgttgtgctaaccgcaaggaggcaggcgaccacggtagggtcagcgactggggtgaagtcgtaacaaggtagccgtaggggaacctgcggctggatcacctcctttctaag

SEQ ID NO: 5566 - DNA, 1492 bp, Mesorhizobium sp. Z1-4
  ref <308>: DATABASE ACCESSION NUMBER: NCBI ACCESSION: NZ_RCIO01000002.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgcccacttcggtgggagcggcagacgggtgagtaacgcgtgggaatctacccagctctacggaacaacccagggaaacttgggctaataccgtatacgtccttcgggagaaagatttatcggagttggatgagcccgcgttggattagctagttggtggggtaatggcctaccaaggcgacgatccatagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggattgttaagtgaggggtgaaatcccggggctcaaccccggaactgcctctcatactggcaatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcgaaatccagagatggattttttcagttaggctggaccggtgacaggtgctgcatggctgtcgtcagctcgtgtcgtgagatgttgggttaagtcccgcaacgagcgcaaccctcgcccctagttgccatcattaagttgggcactctagggggactgccggtgataagccgagaggaaggtggggatgacgtcaagtcctcatggcccttacgggctgggctacacacgtgctacaatggtggtgacagtgggcagcgagaccgcaaggtcgagctaatctccaaaaaccatctcagttcggattgttctctgcaactcgagagcatgaagttggaatcgctagtaatcgtggatcagcatgccacggtgaatacgttcccgggccttgtacacaccgcccgtcacaccatgggagttggctttacccgaaggcgctgcgctaaccgcaaggaggcaggcgaccacggtagggtcagcgactggggtgaagtcgtaacaaggtagccgtaggggaacctgcggctggatcacctcctttctaa

SEQ ID NO: 5567 - DNA, 1489 bp, Mesorhizobium tamadayense
  ref <308>: DATABASE ACCESSION NUMBER: NCBI ACCESSION: NZ_RQXT01000019.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggaatccttcagttcggctggaccggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5568 - DNA, 1489 bp, Mesorhizobium waimense
  ref <308>: DATABASE ACCESSION NUMBER: NCBI ACCESSION: NZ_QZWZ01000017.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcaggcttaacacatgcaagtcgagcgccccgcaaggggagcggcagacgggtgagtaacgcgtgggaatctacccatctctacggaacaactccgggaaactggagctaataccgtatacgtccttcgggagaaagatttatcggagatggatgagcccgcgttggattagctagttggtggggtaatggcctaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaacggtgaagataatgacggtaaccgtagaagaagccccggctaacttcgtgccagcagccgcggtaatacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatggaagctagccgttggcaagtttacttgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggtttccagagatggattccttcagttcggctggaccggtgacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 5569 - DNA, 1537 bp, Mesosutterella multiformis
  ref <308>: DATABASE ACCESSION NUMBER: NCBI ACCESSION: NZ_BGZJ01000001.1
  ref <309>: DATABASE ENTRY DATE: 2019-04-01
  ref <313>: RELEVANT RESIDUES IN SEQ ID NO: (1)..(1537)
gattgaactcaagagtttgatcctggctcagattgaacgctggcggcatgccttacacatgcaagtcgaacggcagcgggggagcttgctcctgccggcgagtggcgaacgggtgagtaatgcatcggaacgtgtcctgttgtgggggataactgatcgaaagatcagctaataccgcatgagacctgagggtgaaagcgggggatcgaaagacctcgcgcgacaggagcggccgatgtctgattagctagttggtgagataaaagcttaccaaggcgacgatcagtagctggtctgagaggatgatcagccacattgggactgagacacggcccagactcctacgggaggcagcagtggggaattttggacaatgggggaaaccctgatccagccatgccgcgtgcgggatgaaggccttcgggttgtaaaccgcttttgtcagagacgaaaagggacgcacgaataatgcgtcccgctgacggtatctgaagaataagcaccggctaactacgtgccagcagccgcggtaatacgtagggtgcaagcgttaatcggaattactgggcgtaaagggtgcgcaggcggctgtgcaagacagatgtgaaatccccgggcttaacctgggaactgcatttgtgactgcacggctagagtttgtcagaggagggtggaattccgcgtgtagcagtgaaatgcgtagatatgcggaagaacaccaatggcgaaggcagccctctgggacatgactgacgctcatgcacgaaagcgtggggagcaaacaggattagataccctggtagtccacgccctaaacgatgtcagctgattgttcgggaagcaattcctgggtaaccaagccaacgcgtgaagctgaccgcctgggaagtacggtcgcaagattaaaactcaaaggaattgacggggacccgcacaagcggtggatgatgtggattaattcgacgcaacgcgaaaaaccttacctagccttgacatgtcaggaacccggatgaaagtctggggtgcccgcaagggagcctgaacacaggtgctgcatggctgtcgtcagctcgtgtcgtgagatgttgggttaagtcccgcaacgagcgcaacccttgtcatcagttgctacgcaagagcactctgatgagaccgccggtgacaaaccggaggaagatggggatgacgtcaagtcctcatggcccttacggctagggcctcacacgtcatacaatggtcggaacagagggcagcgaagccgggaggcggagctaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggtttgccagaaggcgtttgtccaaccgtaaggaggacggcgaccacggtgggttccatgactggggtgaagtcgtaacaaggtagcagtaccggaaggtgcggctggatcacctccttt

SEQ ID NO: 5570 - DNA, 1531 bp, Mesotoga sp. B105.6.4
  ref <308>: DATABASE ACCESSION NUMBER: NCBI ACCESSION: NZ_JWIM01000035.1
  ref <309>: DATABASE ENTRY DATE: 2019-04-01
  ref <313>: RELEVANT RESIDUES IN SEQ ID NO: (1)..(1531)
tggatggagggtttgatcctggctcagggtgaacgctggcggcgtgcttgacacatgcaagtcgaacggtatgtggcaacacatagagtggcgaacgggtgagtaacacgtgggaacgtaccctacgcagggggataactgaccgaaaggacagctaataccgcataagaccgaaaggtgaaaggtgcaactgcaccggcgaaggagcggcccgcggaccatcagctagttggtggggtaagagcctaccaaggcaacgacggatagccggcgtgagagcgtggccggccacaaggacactgagatacgggtcctactcctacgggaggcagcagtgcggaattttagataatggaggcaactctgatctagcgacgccgcgtgcaggaagaaggtcttcggattgtaaactgctgtggtaagggaaaaatgccatgtagagtggaaagctacatggagggatggtactttactagaaagccccggctaactacgtgccagcagccgcggtaatacgtagggggcgagcgttacccggaatcactgggcgtaaagggagcgtaggtggcctgacatgtcaactgtgaaaacccggagctcaactccggacttgcagttgaaactgccaggcttgaggacggtagaggaagacggaactgccagtgtaggggtaaaatccttagatattggcaggaacgccggtgacgaaggtggttttctgggccggttctgacactgatgctcgaaagccaggggagcgaacgggattagataccccggtagtcctggccctaaacgatgttcactaggtgtggggagcggaaagctttccgtgctaaagctaacgcaataagtgaaccgcctggggagtacgcccgcaagggtgaaactcaaaggaattgacgggggcccgcacaagcggtggagcgtgtggtttaattcgatgctaagcgaaggaccttaccaaggtttgacatgctgatagtagtgaattgaaagaggaacgaccacactttgtgtggagtcagcacaggtggtgcacggccgtcgtcagctcgtgccgtgaggtgttgggttaagtcccgcaacgagcgcaacccctgctcttagttgccagcggtaaggccgggcactctaggaggaccgccgccgacgaggcggaggaagggggggatgacgtcaggtatcgtgccccttatatcttgggcgacacacgcgctacaatgggttggacagaagggaccgagacagcgatgtggaggaaatcctcaaaccaacccccagttcagattgcaggctgcaacccgcctgcatgaagccggaatcgctagtaatcgcagatcagccaagctgcggtgaatacgttcccgggccttgtacacaccgcccgtcaagccacccgagttggtaacacctgaagatgagtatcctaaccgtaaggagggagcttgtttagggtgggattggcaaggggggctaagtcgtaacaaggtagccctaccggaaggtggggctggatcacctcctttct

SEQ ID NO: 5571 - DNA, 1531 bp, Mesotoga sp. BH458 6 3 2 1
  ref <308>: DATABASE ACCESSION NUMBER: NCBI ACCESSION: NZ_JFHL01000028.1
  ref <309>: DATABASE ENTRY DATE: 2019-04-01
  ref <313>: RELEVANT RESIDUES IN SEQ ID NO: (1)..(1531)
tggatggagggtttgatcctggctcagggtgaacgctggcggcgtgcttgacacatgcaagtcgaacggtatgtggcaacacatagagtggcgaacgggtgagtaacacgtgggaacgtaccttctgcagggggataactgaccgaaaggacagctaataccgcataagaccgagaggagaaaggtgcaacagcatcggcagaggagcggcccgcggaccatcagctagttggtggggtaagagcctaccaaggcaacgacggatagccggcgtgagagcgtggccggccacaaggacactgagatacgggtcctactcctacgggaggcagcagtgcggaattttagataatggaggcaactctgatctagcgacgccgcgtgcaggaagaaggtcttcggattgtaaactgctgtggtaagggaaaaatgccatgtagagtggaaagctacatggagggatggtactttactagaaagccccggctaactacgtgccagcagccgcggtaatacgtagggggcgagcgttacccggaatcactgggcgtaaagggagcgtaggtggcctgacatgtcgactgtgaaaacccggagctcaactccggacttgcagttgaaactgccaggcttgaggacggtagaggaagacggaactgccagtgtaggggtaaaatccttagatattggcaggaacgccggtgacgaaggtggttttctgggccggttctgacactgatgctcgaaagccaggggagcgaacgggattagataccccggtagtcctggccctaaacgatgttcactaggtgtggggagcggaaagctttccgtgctaaagctaacgcgataagtgaaccgcctggggagtacgcccgcaagggtgaaactcaaaggaattgacgggggcccgcacaagcggtggagcgtgtggtttaattcgatgctaagcgaaggaccttaccaaggtttgacatgctgatagtagtgaattgaaagaggaacgaccacactttgtgtggagtcagcacaggtggtgcacggccgtcgtcagctcgtgccgtgaggtgttgggttaagtcccgcaacgagcgcaacccctgctcttagttgccagcggtaaggccgggcactctaggaggaccgccgccgacgaggcggaggaagggggggatgacgtcaggtatcgtgccccttatatcttgggcgacacacgcgctacaatgggttggacagaagggaccgagacagcaatgtggaggaaatcctcaaaccaacccccagttcagattgcaggctgcaacccgcctgcatgaagccggaatcgctagtaatcgcagatcagccaagctgcggtgaatacgttcccgggccttgtacacaccgcccgtcaagccacccgagttggtaacacctgaagatgagtatcctaaccgtaaggagggagcttgtttagggtgggattggcaaggggggctaagtcgtaacaaggtagccctaccggaaggtggggctggatcacctcctttct

SEQ ID NO: 5572 - DNA, 1531 bp, Mesotoga sp. Brook.08.105.5.1
  ref <308>: DATABASE ACCESSION NUMBER: NCBI ACCESSION: NZ_AYTW01000039.1
  ref <309>: DATABASE ENTRY DATE: 2019-04-01
  ref <313>: RELEVANT RESIDUES IN SEQ ID NO: (1)..(1531)
tggatggagggtttgatcctggctcagggtgaacgctggcggcgtgcttgacacatgcaagtcgaacggtatgtggcaacacatagagtggcgaacgggtgagtaacacgtgggaacgtaccctacgcagggggataactgaccgaaaggacagctaataccgcataagaccgaaaggtgaaaggtgcaactgcaccggcgaaggagcggcccgcggaccatcagctagttggtggggtaagagcctaccaaggcaacgacggatagccggcgtgagagcgtggccggccacaaggacactgagatacgggtcctactcctacgggaggcagcagtgcggaattttagataatggaggcaactctgatctagcgacgccgcgtgcaggaagaaggtcttcggattgtaaactgctgtggtaagggaaaaatgccatgtagagtggaaagctacatggagggatggtactttactagaaagccccggctaactacgtgccagcagccgcggtaatacgtagggggcgagcgttacccggaatcactgggcgtaaagggagcgtaggtggcctgacatgtcaactgtgaaaacccggagctcaactccggacttgcagttgaaactgccaggcttgaggacggtagaggaagacggaactgccagtgtaggggtaaaatccttagatattggcaggaacgccggtgacgaaggtggttttctgggccggttctgacactgatgctcgaaagccaggggagcgaacgggattagataccccggtagtcctggccctaaacgatgttcactaggtgtggggagcggaaagctttccgtgctaaagctaacgcaataagtgaaccgcctggggagtacgcccgcaagggtgaaactcaaaggaattgacgggggcccgcacaagcggtggagcgtgtggtttaattcgatgctaagcgaaggaccttaccaaggtttgacatgctgatagtagtgaattgaaagaggaacgaccacactttgtgtggagtcagcacaggtggtgcacggccgtcgtcagctcgtgccgtgaggtgttgggttaagtcccgcaacgagcgcaacccctgctcttagttgccagcggtaaggccgggcactctaggaggaccgccgccgacgaggcggaggaagggggggatgacgtcaggtatcgtgccccttatatcttgggcgacacacgcgctacaatgggttggacagaagggaccaagacagcgatgtggaggaaatcctcaaaccaacccccagttcagattgcaggctgcaacccgcctgcatgaagccggaatcgctagtaatcgcagatcagccaagctgcggtgaatacgttcccgggccttgtacacaccgcccgtcaagccacccgagttggtaacacctgaagatgagtatcctaaccgtaaggagggagcttgtttagggtgggattggcaaggggggctaagtcgtaacaaggtagccctaccggaaggtggggctggatcacctcctttct

SEQ ID NO: 5573 - DNA, 1531 bp, Mesotoga sp. Brook.08.YT.4.2.5.1; identical to SEQ ID NO: 5570
  ref <308>: DATABASE ACCESSION NUMBER: NCBI ACCESSION: NZ_AYTX01000027.1
  ref <309>: DATABASE ENTRY DATE: 2019-04-01
  ref <313>: RELEVANT RESIDUES IN SEQ ID NO: (1)..(1531)

SEQ ID NO: 5574 - DNA, 1531 bp, Mesotoga sp. Brook.08.YT.4.2.5.4.; identical to SEQ ID NO: 5572
  ref <308>: DATABASE ACCESSION NUMBER: NCBI ACCESSION: NZ_ATCT01000056.1
  ref <309>: DATABASE ENTRY DATE: 2019-04-01
  ref <313>: RELEVANT RESIDUES IN SEQ ID NO: (1)..(1531)

SEQ ID NO: 5575 - DNA, 1531 bp, Mesotoga sp. H07.pep.5.3
  ref <308>: DATABASE ACCESSION NUMBER: NCBI ACCESSION: NZ_AYTV01000009.1
  ref <309>: DATABASE ENTRY DATE: 2019-04-01
  ref <313>: RELEVANT RESIDUES IN SEQ ID NO: (1)..(1531)
tggatggagggtttgatcctggctcagggtgaacgctggcggcgtgcttgacacatgcaagtcgaacggtatgtggcaacacatagagtggcgaacgggtgagtaacacgtgggaacgtaccctacgcagggggataactgaccgaaaggacagctaataccgcataagaccgaaaggtgaaaggtgcaaatgcatcggcgaaggagcggcccgcggaccatcagctagttggtggggtaagagcctaccaaggcgacgacggttagccggcgtgagagcgtggccggccacaaggacactgagatacgggtcctactcctacgggaggcagcagtgcggaattttagataatggaggcaactctgatctagcgacgccgcgtgcaggaagaaggtcttcggattgtaaactgctgtggtaagggaaaaatgtcatgtagagtggaaagctacatggagggatggtactttactagaaagccccggctaactacgtgccagcagccgcggtaatacgtagggggcgagcgttacccggaatcactgggcgtaaagggagcgtaggtggcctgacatgtcaactgtgaaaacccggagctcaactccggacttgcagttgaaactgccaggcttgaggacggtagaggaagacggaactgccagtgtaggggtaaaatccttagatattggcaggaacgccggtgacgaaggtggttttctgggccggttctgacactgatgctcgaaagccaggggagcgaacgggattagataccccggtagtcctggccctaaacgatgttcactaggtgtggggagcggaaagctttccgtgctaaagctaacgcgataagtgaaccgcctggggagtacgcccgcaagggtgaaactcaaaggaattgacgggggcccgcacaagcggtggagcgtgtggtttaattcgatgctaagcgaaggaccttaccaaggtttgacatgctgatagtagtgaattgaaagaggaacgaccacactttgtgtggagtcagcacaggtggtgcacggccgtcgtcagctcgtgccgtgaggtgttgggttaagtcccgcaacgagcgcaacccctgctcttagttgccagcggtaaggccgggcactctaagaggaccgccgccgacgaggcggaggaagggggggatgacgtcaggtatcgtgccccttatatcttgggcgacacacgcgctacaatgggttggacagaagggaccgagacagcgatgtggaggaaatcctcaaaccaacccccagttcagattgcaggctgcaacccgcctgcatgaagccggaatcgctagtaatcgcagatcagccaagctgcggtgaatacgttcccgggccttgtacacaccgcccgtcaagccacccgagttggtaacacctgaagatgagtatcctaaccgaaaggagggagcttgtttagggtgggattggcaaggggggctaagtcgtaacaaggtagccctaccggaaggtggggctggatcacctcctttct

SEQ ID NO: 5576 - DNA, 1531 bp, Mesotoga sp. H07pep.5.4
  ref <308>: DATABASE ACCESSION NUMBER: NCBI ACCESSION: NZ_JFHM01000034.1
  ref <309>: DATABASE ENTRY DATE: 2019-04-01
  ref <313>: RELEVANT RESIDUES IN SEQ ID NO: (1)..(1531)
tggatggagggtttgatcctggctcagggtgaacgctggcggcgtgcttgacacatgcaagtcgaacggtatgtggcaacacatagagtggcgaacgggtgagtaacacgtgggaacgtaccctacgcagggggataactgaccgaaaggacagctaataccgcataagaccgaaaggtgaaaggtgcaaatgcatcggcgaaggagcggcccgcggaccatcagctagttggtggggtaagagcctaccaaggcgacgacggttagccggcgtgagagcgtggccggccacaaggacactgagatacgggtcctactcctacgggaggcagcagtgcggaattttagataatggaggcaactctgatctagcgacgccgcgtgcaggaagaaggtcttcggattgtaaactgctgtggtaagggaaaaatgtcatgtagagtggaaagctacatggagggatggtactttactagaaagccccggctaactacgtgccagcagccgcggtaatacgtagggggcgagcgttacccggaatcactgggcgtaaagggagcgtaggtggcctgacatgtcaactgtgaaaacccggagctcaactccggacttgcagttgaaactgccaggcttgaggacggtagaggaagacggaactgccagtgtaggggtaaaatccttagatattggcaggaacgccggtgacgaaggtggttttctgggccggttctgacactgatgctcgaaagccaggggagcgaacgggattagataccccggtagtcctggccctaaacgatgttcactaggtgtggggagcggaaagctttccgtgctaaagctaacgcgataagtgaaccgcctggggagtacgcccgcaagggtgaaactcaaaggaattgacgggggcccgcacaagcggtggagcgtgtggtttaattcgatgctaagcgaaggaccttaccaaggtttgacatgctgatagtagtgaattgaaagaggaacgaccacactttgtgtggagtcagcacaggtggtgcacggccgtcgtcagctcgtgccgtgaggtgttgggttaagtcccgcaacgagcgcaacccctgctcttagttgccagcggtaaggccgggcactctaggaggaccgccgccgacgaggcggaggaagggggggatgacgtcaggtatcgtgccccttatatcttgggcgacacacgcgctacaatgggttggacagaagggaccgagacagcaatgtggaggaaatcctcaaaccaacccccagttcagattgcaggctgcaacccgcctgcatgaagccggaatcgctagtaatcgcagatcagccaagctgcggtgaatacgttcccgggccttgtacacaccgcccgtcaagccacccgagttggtaacacctgaagatgagtatcctaaccgaaaggagggagcttgtttagggtgggattggcaaggggggctaagtcgtaacaaggtagccctaccggaaggtggggctggatcacctcctttct

SEQ ID NO: 5577 - DNA, 1531 bp, Mesotoga sp. HF07.pep.5.2.highcov; identical to SEQ ID NO: 5576
  ref <308>: DATABASE ACCESSION NUMBER: NCBI ACCESSION: NZ_JFHJ01000017.1
  ref <309>: DATABASE ENTRY DATE: 2019-04-01
  ref <313>: RELEVANT RESIDUES IN SEQ ID NO: (1)..(1531)

SEQ ID NO: 5578 - DNA, 1531 bp, Mesotoga sp. TolDC
  ref <308>: DATABASE ACCESSION NUMBER: NCBI ACCESSION: NZ_AYSI01000008.1
  ref <309>: DATABASE ENTRY DATE: 2019-04-01
  ref <313>: RELEVANT RESIDUES IN SEQ ID NO: (1)..(1531)
tggatggagggtttgatcctggctcagggtgaacgctggcggcgtgcttgacacatgcaagtcgaacggtatgtggcaacacatagagtggcgaacgggtgagtaacacgtgggaacgtaccttctgcagggggataactgaccgaaaggacagctaataccgcataagaccgagaggagaaaggtgcaacagcatcggcagaggagcggcccgcggaccatcagctagttggtggggtaagagcctaccaaggcaacgacggatagccggcgtgagagcgtggccggccacaaggacactgagatacgggtcctactcctacgggaggcagcagtgcggaattttagataatggaggcaactctgatctagcgacgccgcgtgcaggaagaaggtcttcggattgtaaactgctgtggtaagggaaaaatgccatgtagagtggaaagctacatggagggatggtactttactagaaagccccggctaactacgtgccagcagccgcggtaatacgtagggggcgagcgttacccggaatcactgggcgtaaagggagcgtaggtggcctgacatgtcgactgtgaaaacccggagctcaactccggacttgcagttgaaactgccaggcttgaggacggtagaggaagacggaactgccagtgtaggggtaaaatccttagatattggcaggaacgccggtgacgaaggtggttttctgggccggttctgacactgatgctcgaaagccaggggagcgaacgggattagataccccggtagtcctggccctaaacgatgttcactaggtgtggggagcggaaagctttccgtgctaaagctaacgcgataagtgaaccgcctggggagtacgcccgcaagggtgaaactcaaaggaattgacgggggcccgcacaagcggtggagcgtgtggtttaattcgatgctaagcgaaggaccttaccaaggtttgacatgctgatagtagtgaattgaaagaggaacgaccacactttgtgtggagtcagcacaggtggtgcacggccgtcgtcagctcgtgccgtgaggtgttgggttaagtcccgcaacgagcgcaacccctgctcttagttgccagcggtaaggccgggcactctaggaggaccgccgccgacgaggcggaggaagggggggatgacgtcaggtatcgtgccccttatatcttgggcgacacacgcgctacaatgggttggacagaagggaccgagacagcgatgtggaggaaatcctcaaaccaacccccagttcagattgcaggctgcaacccgcctgcatgaagccggaatcgctagtaatcgcagatcagccaagctgcggtgaatacgttcccgggccttgtacacaccgcccgtcaagccacccgagttggtaacacctgaagatgagtatcctaaccgaaaggagggagcttgtttagggtgggattggcaaggggggctaagtcgtaacaaggtagccctaccggaaggtggggctggatcacctcctttct

SEQ ID NO: 5579 - DNA, 1552 bp, Metakosakonia massiliensis
  ref <308>: DATABASE ACCESSION NUMBER: NCBI ACCESSION: NZ_CAEO01000171.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggtgataaagcgaatacctttatcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacccgggaactgcattcgaaactgacaggctggagtcttgtagaggggggtggaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 5580 - DNA, 1552 bp, Metakosakonia sp. MRY16-398
  ref <308>: DATABASE ACCESSION NUMBER: NCBI ACCESSION: NZ_AP018756.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtagcacagaggagcttgctccttgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagcttgttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcaatacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattcggcagagatgccttagtgccttcgggagccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 5581 - DNA, 1534 bp, Methylacidiphilum fumariolicum
  ref <308>: DATABASE ACCESSION NUMBER: NCBI ACCESSION: NZ_LM997411.1
  ref <309>: DATABASE ENTRY DATE: 2019-04-01
  ref <313>: RELEVANT RESIDUES IN SEQ ID NO: (1)..(1534)
ttacggagagtttgattctggctcagagcgaacgctggcggcgtggataagacatgcaagtcgaacgaagcttgttccttggcaacaaggaacaagttcagtggcgaacgggtgagtaacacgtgggaacttaccctgaagtggggaatagcccatcgaaagatggggtaattccgcatgtgatcgaaagatcaaagtaggggacctgcaaaggccttacgcttcaggagaggcccgcggcccatcagctagttggtgaggtaatggcccaccaaggctaagacgggtagctggcctgagagggtggtcagccacactgggactgagacacggcccagacacctacgggtggcagcagtcgagaatttttcacaatgggcgaaagcctgatggagcgacgccgcgtggaggatgaaggccttcgggttgtaaactcctgtcaccctggaccaaggctttcaagttgaataaacttggaagtttgattgtacagggagaggaagggacggcaaactctgtgccagcagccgcggtaatacagaggtcccaagcgttgctcggatttactgggcgtaaagggtgtgtaggaggttagataagtcggatgtgaaatccctttgcttaacaaaggaactgcattcgatactgtctagctagaggaccggagggggaagcggaactctcggtgtagcggtgaaatgcgtggatatcgagaggaacaccggtggcgaaggcggcttcctggacggtacctgactctgatacacgaaagctaggggagcgaacgggattagataccccggtagtcctagccgtaaacggtgtgcgttaggcgttggcggaatcgaccccgccagtgccgtagctaacgcgttaaacgcaccgcctgaggagtacggccgcaaggctaaaactcaaagaaattgacgggggcccgcacaagcggtggagcatgtggcttaattcgatgcaacgcgaagaaccttaccaggccttgacatgccgtgttcagttgctgaaaggcaatggcccgcaagggcgaacggcacaggtgctgcatggctgtcgtcagctcgtgtcgtgagatgttgggttaagtcccgcaacgagcgcaacccctatgtccagttgccgaaaggctctctgaacagactgcctcgtataacggggaggaaggtggggacgacgtcaagtcaggatggcccttatggcctgggctgcacacgtgttacaatgcccggtacagagggaagcaagaccgcgaggtggagcaaatcccaaaaaccgggcccagttcagatcgaaggctgcaactcgccttcgtgaagccggaatcgctagtaatggcgcatcagctacggcgccgtgaatacgttcccgggccttgtacacaccgcccgtcacatcctgaaagctggttgtacccgaagccaaccgtaaggttgtcgaaggtatggctagtgattgggatgaagtcgtaacaaggtagccgtaggggaacctgcggctggatcacctcctttctaaggagtaa

SEQ ID NO: 5582 - DNA, 1535 bp, Methylacidiphilum infernorum
  ref <308>: DATABASE ACCESSION NUMBER: NCBI ACCESSION: NC_010794.1
  ref <309>: DATABASE ENTRY DATE: 2019-04-01
  ref <313>: RELEVANT RESIDUES IN SEQ ID NO: (1)..(1535)
ttacggagagtttgattctggctcagagcgaacgctggcggcgtggataagacatgcaagtcgaacgcagcttgtcccttggcaacaaggggcaagttcagtggcgaacgggtgagtaacacgtgggaacttgccctgaagtggggaatagcccatcgaaaggtggggtaattccgcatgtggtcgaaagatcaaagtaggggacctgaaaaggccttacgcttcaggagaggcccgcggcccatcagctagttggtgaggtaatggcccaccaaggctaagacgggtagctggcctgagagggtggtcagccacactgggactgagacacggcccagacacctacgggtggcagcagtcgagaatttttcacaatgggcgaaagcctgatggagcgacgccgcgtggaggatgaaggccttcgggttgtaaactcctgtcaccctggaccaaggcttttaggttgaataaacctggaagcttgattgtacagggagaggaagggacggcaaactctgtgccagcagccgcggtaatacagaggtcccgagcgttgctcggatttactgggcgtaaagggtgtgtaggaggttagataagtcagatgtgaaatccctttgctcaacgaaggaactgcatttgatactgtctagctagaggaccggagggggaagcggaactctcggtgtagcggtgaaatgcgtggatatcgagaggaacaccggtggcgaaggcggcttcctggacggtacctgactctgatacacgaaagctaggggagcgaacgggattagataccccggtagtcctagccgtaaacggtgtgcgttaggcgttggcggaatcgaccccgccagtgccgtagctaacgcgttaaacgcaccgcctgaggagtacggccgcaaggctaaaactcaaagaaattgacgggggcccgcacaagcggtggagcatgtggcttaattcgatgcaacgcgaagaaccttaccaggccttgacatgccgtgttcagttaccgaaaggtaatggcccgcaagggcgaacggcacaggtgctgcatggctgtcgtcagctcgtgtcgtgagatgttgggttaagtcccgcaacgagcgcaacccctatgtccagttgccgaaaggctctctgaacagactgcctcgtacaacggggaggaaggtggggacgacgtcaagtcaggatggcccttatggcctgggctgcacacgtgttacaatgcccggtacagagggaagcaagaccgcgaggtggagcaaatcccaaaaaccgggcccagttcagatcgaaggctgcaactcgccttcgtgaagccggaatcgctagtaatggcgcatcagctacggcgccgtgaatacgttcccgggccttgtacacaccgcccgtcacatcctgaaagctggttgtacccgaagccaatcgtaagattgtcgaaggtatggctagtgattgggatgaagtcgtaacaaggtagccgtaggggaacctgcggctggatcacctcctttctaaggagtaag

SEQ ID NO: 5583 - DNA, 1534 bp, Methylacidiphilum kamchatkense
  ref <308>: DATABASE ACCESSION NUMBER: NCBI ACCESSION: NZ_JQNX01000005.1
  ref <309>: DATABASE ENTRY DATE: 2019-04-01
  ref <313>: RELEVANT RESIDUES IN SEQ ID NO: (1)..(1534)
ttacggagagtttgattctggctcagagcgaacgctggcggcgtggataagacatgcaagtcgaacgaagcttgttccttggcaacaaggaacaagttcagtggcgaacgggtgagtaacacgtgggaacttaccctgaagtggggaatagcccatcgaaagatggggtaattccgcatgtgatcgaaagatcaaagtaggggacctgtaaaggccttacgcttcaggagaggcccgcggcccatcagctagttggtgaggtaatggcccaccaaggctaagacgggtagctggcctgagagggtggtcagccacactgggactgagacacggcccagacacctacgggtggcagcagtcgagaatttttcacaatgggcgaaagcctgatggagcgacgccgcgtggaggatgaaggccttcgggttgtaaactcctgtcaccctggaccaaggctttcaggttgaataaacctggaagtttgattgtacagggagaggaagggacggcaaactctgtgccagcagccgcggtaatacagaggtcccaagcgttgctcggatttactgggcgtaaagggtgtgtaggaggttagataagtcggatgtgaaatccctttgcttaacaaaggaactgcattcgatactgtctagctagaggaccggagggggaagcggaactctcggtgtagcggtgaaatgcgtggatatcgagaggaacaccggtggcgaaggcggcttcctagacggtacctgactctgatacacgaaagctaggggagcgaacgggattagataccccggtagtcctagccgtaaacggtgtgcgttaggcgttggcggaatcgaccccgccagtgccgtagctaacgcgttaaacgcaccgcctgaggagtacggccgcaaggctaaaactcaaagaaattgacgggggcccgcacaagcggtggagcatgtggcttaattcgatgcaacgcgaagaaccttaccaggccttgacatgccgtgttcagttgctgaaaggcaatggcccgcaagggcgaacggcacaggtgctgcatggctgtcgtcagctcgtgtcgtgagatgttgggttaagtcccgcaacgagcgcaacccctatgtccagttgccgaaaggctctctgaacagactgcctcgtataacggggaggaaggtggggacgacgtcaagtcaggatggcccttatggcctgggctgcacacgtgttacaatgcccggtacagagggaagcaagaccgcgaggtggagcaaatcccaaaaaccgggcccagttcagatcgaaggctgcaactcgccttcgtgaagccggaatcgctagtaatggcgcatcagctacggcgccgtgaatacgttcccgggccttgtacacaccgcccgtcacatcctgaaagctggttgtacccgaagccaaccgtaaggttgtcgaaggtatggctagtgattgggatgaagtcgtaacaaggtagccgtaggggaacctgcggctggatcacctcctttctaaggagtaa

SEQ ID NO: 5584 - DNA, 1461 bp, Methylarcula marina
  ref <308>: DATABASE ACCESSION NUMBER: NCBI ACCESSION: NZ_PXNQ02000023.1
  ref <309>: DATABASE ENTRY DATE: 2019-04-01
  ref <313>: RELEVANT RESIDUES IN SEQ ID NO: (1)..(1461)
caacttgagagtttgatcctggctcagaacgaacgctggcggcaggcttaacacatgcaagtcgagcgatcccttcggggatagcggcggacgggtgagtaacgcgtgggaacgtgcccttcactgcggaatagcccagggaaacttggattaataccgcatacgcttcgggggaaagaatttcggtgaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggacaggaaagttgggggtgaaatcccggggctcaaccccggaactgccttcaaaactatctgtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgggaccgcaccagagatggtgtttccacttcggtggctcggagacaggtgctgcatggctgtcgtcagctcgtgtcgtgagatgttcggttaagtccggcaacgagcgcaacccacgtccctagttgccagcattcagttgggcactctatggaaactgccggtgataagccggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagttggaatcgctagtaatcgcggaacagcatgccgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttcta

SEQ ID NO: 5585 - DNA, 1539 bp, Methylibium sp. Pch-M
  ref <308>: DATABASE ACCESSION NUMBER: NCBI ACCESSION: NZ_CP029606.1
  ref <309>: DATABASE ENTRY DATE: 2019-04-01
  ref <313>: RELEVANT RESIDUES IN SEQ ID NO: (1)..(1539)
agatcgaactgaagagtttgatcctggctcagattgaacgctggcggcatgccttacacatgcaagtcgaacggcagcacgggagcaatcctggtggcgagtggcgaacgggtgagtaatacatcggaacgtgcccagttgtgggggatagcccggcgaaagccggattaataccgcatacgacctacgggtgaaagcgggggatcgcaagacctcgcgctattggagcggccgatgtcggattagctagttggtggggtaaaagcctaccaaggctacgatccgtagctggtctgagaggacgaccagccacactgggactgagacacggcccagactcctacgggaggcagcagtggggaattttggacaatgggcgcaagcctgatccagccatgccgcgtgcgggaagaaggccttcgggttgtaaaccgcttttgtcagggaagaaacggtttgagctaatatctcgaactaatgacggtacctgaagaataagcaccggctaactacgtgccagcagccgcggtaatacgtagggtgcaagcgttaatcggaattactgggcgtaaagcgtgcgcaggcggctttgcaagacagatgtgaaatccccgggctcaacctgggaactgcatttgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggacggcttgctgttcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgtctagaagttaccagagatggtttcgtgctcgaaagagaactagaacacaggtgctgcatggccgtcgtcagctcgtgtcgtgagatgttgggttaagtcccgcaacgagcgcaacccttgtcattagttgctacgtaagggcactctaatgagactgccggtgacaaaccggaggaaggtggggatgacgtcaggtcatcatggcccttatgggtagggctacacacgtcatacaatggccggtacagagggctgccaacccgcgagggggagccaatcccagaaaaccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 5586 - DNA, 1536 bp, Methylobacter sp. KRF1
  ref <308>: DATABASE ACCESSION NUMBER: NCBI ACCESSION: NZ_RYFG01000123.1
  ref <309>: DATABASE ENTRY DATE: 2019-04-01
  ref <313>: RELEVANT RESIDUES IN SEQ ID NO: (1)..(1536)
taaactgaagagtttgatcatggctcagattgaacgctggcggtatgcttaacacatgcaagtcgaacggtagcaggccttcgggcgctgacgagtggcggacgggtgagtaacgcgtaggaatctgcctcatagtgggggacaacgtggggaaactcacgctaataccgcatacgccctacgggggaaagcgggggaccttcgggcctcgcgctatgagatgagcctgcgttagattagctagttggtggggtaaaggcctaccaaggcgacgatctatagctggtctgagaggacgatcagccacactgggactgagacacggcccagactcctacgggaggcagcagtggggaatattggacaatgggggaaaccctgatccagcaataccgcgtgtgtgaagaaggccttagggttgtaaagcactttcaattgggaggaaaacctaccggtcaatacccggtagcttgacattacctttagaagaagcaccggctaactccgtgccagcagccgcggtaatacggagggtgcaagcgttaatcggaattactgggcgtaaagcgtgcgtaggcggttcgttaagtcagatgtgaaagccctgggctcaacctgggaactgcatttgaaactggcggactcgagtttagtagaggggagtggaatttcaggtgtagcggtgaaatgcgtagatatctgaaggaacaccagtggcgaaggcgactccctggactaaaactgacgctgaggtacgaaagcgtgggtagcaaacaggattagataccctggtagtccacgccgtaaacgatgtcgactagccgttggtcctatttacaggattagtggcgcagctaacgcattaagtcgaccgcctggggagtacggccgcaaggttaaaactcaaatgaattgacgggggcccgcacaagcggtggagcatgtggtttaattcgatgcaacgcgaagaaccttacctacccttgacatccagagaatctgttagagatagtagagtgccttcgggagctctgagacaggtgctgcatggctgtcgtcagctcgtgttgtgaaatgttgggttaagtcccgtaacgagcgcaacccttatccttagttgccagcgggtcatgccgggaactctagggagactgccggtgataaaccggaggaaggtggggacgacgtcaagtcatcatggcccttatgggtagggctacacacgtgctacaatggtcggtacagagggctgcgaaaccgcgaggtcaagcaaatcccagaaagccgatcctagtccggattggagtctgcaactcgactccatgaagtcggaatcgctagtaatcgcgaatcagaatgtcgcggtgaatacgttcccgggccttgtacacaccgcccgtcacaccatgggagtgggttgcaaaagaagtgggtagtctaaccttcgggagggcgctcaccactttgtgattcatgactggggtgaagtcgtaacaaggtagccctaggggaacctggggctggatcacctcctta

SEQ ID NO: 5587 - DNA, 1542 bp, Methylobacterium currus
  ref <308>: DATABASE ACCESSION NUMBER: NCBI ACCESSION: NZ_CP028843.1
  ref <309>: DATABASE ENTRY DATE: 2019-04-01
  ref <313>: RELEVANT RESIDUES IN SEQ ID NO: (1)..(1542)
agcctccgttactattgtgatcagctatgatcagctcttcaacttgagagtttgatcctggctcagagcgaacgctggcggcaggcttaacacatgcaagtcgagcgggcccttcggggtcagcggcagacgggtgagtaacgcgtgggaacgtgcccttcggttcggaataactcagggaaacttgagctaataccggatacgcccttatggggaaaggcttgactgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcgtgttatccggagagatccggggtccccttcgggggcgcgcacacaggtgctgcatggctgtcgtcagctcgtgtcgtgagatgttgggttaagtcccgcaacgagcgcaacccacgtccctagttgccatcatttggttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaacctgatcgagcttgctcgactagggggcaggcgaccacggtagggtcagcgactggggtgaagtcgtaacaaggtagccgtaggggaacctgcggctggatcacctcctttcta

SEQ ID NO: 5588 - DNA, 1502 bp, Methylobacterium indicum
  ref <308>: DATABASE ACCESSION NUMBER: NCBI ACCESSION: NZ_LDRN01000063.1
  ref <309>: DATABASE ENTRY DATE: 2019-04-01
  ref <313>: RELEVANT RESIDUES IN SEQ ID NO: (1)..(1502)
atgatcagctcttcaacttgagagtttgatcctggctcagagcgaacgctggcggcaggcttaacacatgcaagtcgagcgggcccttcggggtcagcggcagacgggtgagtaacgcgtgggaacgtgcccttcggttcggaataactcagggaaacttgagctaataccggatacgtgcgagagcagaaaggtttactgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactgattggctcgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgcgaggtcgagagatcggctgttcccttcggggacgtgcacacaggtgctgcatggctgtcgtcagctcgtgtcgtgagatgttgggttaagtcccgcaacgagcgcaacccacgtcctcagttgccatcatttggttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaactggcaacaggggcaggcgaccacggtagggtcagcgactggggtgaagtcgtaacaaggtagccgtaggggaacctgcggctggatcacctcctttctaa

SEQ ID NO: 5589 - DNA, 1491 bp, Methylobacterium mesophilicum
  ref <308>: DATABASE ACCESSION NUMBER: NCBI ACCESSION: NZ_ANPA01000016.1
  ref <309>: DATABASE ENTRY DATE: 2019-04-01
  ref <313>: RELEVANT RESIDUES IN SEQ ID NO: (1)..(1491)
ctcttcaacgtgagagtttgatcctggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacgtggagagattcacggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaagggggcaggcgaccacggtagggtcagcgactggggtgaagtcgtaacaaggtagccgtaggggaacctgcggctggatcacctcctttcta

SEQ ID NO: 5590 - DNA, 1524 bp, Methylobacterium nodulans
  ref <308>: DATABASE ACCESSION NUMBER: NCBI ACCESSION: NC_011894.1
  ref <309>: DATABASE ENTRY DATE: 2019-04-01
  ref <313>: RELEVANT RESIDUES IN SEQ ID NO: (1)..(1524)
ttgtgatcgagcgttttgaggtcagctcttcaaggtgagagtttgatcctggctcagagcgaacgctggcggcaggcttaacacatgcaagtcgagcgggccctgcggggtcagcggcagacgggtgagtaacgcgtgggaacgtgcccttcggttcggaacaaccctgggaaactagggctaataccggatacgtccgcaaggagaaaggcttgactgccgaaggatcggcccgcgtctgattagctggttggtggggtaacggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccttagggttgtaaagctcttttcttcgggacgataatgacggtaccggaggaataagccccggctaacttcgtgccagcagccgcggtaatacgaagggggctagcgttgctcggaatcactgggcgtaaagggcgcgtaggcggctcgccaagtcgggggtgaaagcccgtggctcaaccacggaatggccttcgatactggcgggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcaggctacgtggagagattcacggttcccttcggggacctgcacacaggtgctgcatggctgtcgtcagctcgtgtcgtgagatgttgggttaagtcccgcaacgagcgcaaccctcgcccttagttgccatcattgagttgggcactctagggggactgccggtgataagccgcgaggaaggtggggatgacgtcaagtcctcatggcccttacgggatgggctacacacgtgctacaatggcggtgacaatgggaagcgaaggggcgacctggagcaaatccccaaaagccgtctcagttcagattgcactctgcaactcgagtgcatgaaggcggaatcgctagtaatcgtggatcagcacgccacggtgaatacgttcccgggccttgtacacaccgcccgtcacaccatgggagttggtcttacccgacggcgctgcgccaaccgcgagggggcaggcgaccacggtagggtcagcgactggggtgaagtcgtaacaaggtagccgtaggggaacctgcggctggatcacctcctttctaaggatgc

SEQ ID NO: 5591 - DNA, 1492 bp, Methylobacterium organophilum
  ref <308>: DATABASE ACCESSION NUMBER: NCBI ACCESSION: NZ_QEKZ01000068.1
  ref <309>: DATABASE ENTRY DATE: 2019-04-01
  ref <313>: RELEVANT RESIDUES IN SEQ ID NO: (1)..(1492)
ctcttcaacgtgagagtttgatcctggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaa

SEQ ID NO: 5592 - DNA, 1513 bp, Methylobacterium oryzae
  ref <308>: DATABASE ACCESSION NUMBER: NCBI ACCESSION: NZ_CP003811.1
  ref <309>: DATABASE ENTRY DATE: 2019-04-01
  ref <313>: RELEVANT RESIDUES IN SEQ ID NO: (1)..(1513)
gtgatcggccagatcaatctcttcaacgtgagagtttgatcctggctcagagcgaacgctggcggcaggcttaacacatgcaagtcgagcggacctttcggggtcagcggcggacgggtgagtaacgcgtgggaacgtgccttcccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtgggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaaactcaaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5593 - DNA, 1522 bp, Methylobacterium platani
  ref <308>: DATABASE ACCESSION NUMBER: NCBI ACCESSION: NZ_LWHQ01000067.1
  ref <309>: DATABASE ENTRY DATE: 2019-04-01
  ref <313>: RELEVANT RESIDUES IN SEQ ID NO: (1)..(1522)
ttgtgatcagctttgatcagctcttcaacttgagagtttgatcctggctcagagcgaacgctggcggcaggcttaacacatgcaagtcgagcgggcatcctcgtggtgtcagcggcagacgggtgagtaacacgtgggaacgtgcccttcggttcggaataactcagggaaacttgagctaataccggatacgcccttttggggaaaggtttatctgccgaaggatcggcccgcgtctgattagctagttggtgaggttatggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttaggcggagagatccgttgtcctcttcggaggcgtgcacacaggtgctgcatggctgtcgtcagctcgtgtcgtgagatgttgggttaagtcccgcaacgagcgcaacccacgtcctcagttgccatcattcagttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaagggggcaggcgaccacggtagggtcagcgactggggtgaagtcgtaacaaggtagccgtaggggaacctgcggctggatcacctcctttctaaggatgc

SEQ ID NO: 5594 - DNA, 1513 bp, Methylobacterium radiotolerans
  ref <308>: DATABASE ACCESSION NUMBER: NCBI ACCESSION: NZ_SAUO01000002.1
  ref <309>: DATABASE ENTRY DATE: 2019-04-01
  ref <313>: RELEVANT RESIDUES IN SEQ ID NO: (1)..(1513)
ttgtgatcagcttagatcaatctcttcaacgtgagagtttgatcctggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaa

SEQ ID NO: 5595 - DNA, 1531 bp, Methylobacterium sp. 10
  ref <308>: DATABASE ACCESSION NUMBER: NCBI ACCESSION: NZ_KI912577.1
  ref <309>: DATABASE ENTRY DATE: 2019-04-01
  ref <313>: RELEVANT RESIDUES IN SEQ ID NO: (1)..(1531)
gcttccgttatgaagtgatcagctagatcaactcttcaacttgagagtttgatcctggctcagagcgaacgctggcggcaggcttaacacatgcaagtcgagcgggcatcttcggatgtcagcggcagacgggtgagtaacacgtgggaacgtacccttcggttcggaacaactctgggaaactggagctaataccggatacgcccttatggggaaaggtttactgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgtaatccggagagatccggggtccacttcggtggcgtgcacacaggtgctgcatggctgtcgtcagctcgtgtcgtgagatgttgggttaagtcccgcaacgagcgcaacccacgtccttagttgccatcatttagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaagggggcaggcgaccacggtagggtcagcgactggggtgaagtcgtaacaaggtagccgtaggggaacctgcggctggatcacctcctttctaaggatgc

SEQ ID NO: 5596 - DNA, 1509 bp, Methylobacterium sp. 13MFTsu3.1M2
  ref <308>: DATABASE ACCESSION NUMBER: NCBI ACCESSION: NZ_FOMM01000001.1
  ref <309>: DATABASE ENTRY DATE: 2019-04-01
  ref <313>: RELEVANT RESIDUES IN SEQ ID NO: (1)..(1509)
gtgatcggccagatcaatctcttcaacgtgagagtttgatcctggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5597 - DNA, 1510 bp, Methylobacterium sp. 17SD2-17
  ref <308>: DATABASE ACCESSION NUMBER: NCBI ACCESSION: NZ_CP029550.1
  ref <309>: DATABASE ENTRY DATE: 2019-04-01
  ref <313>: RELEVANT RESIDUES IN SEQ ID NO: (1)..(1510)
gtgatcagctatgattgaactcttcaacttgagagtttgatcctggctcagagcgaacgctggcggcaggcttaacacatgcaagtcgaacgcatccttcggggtgagtggcagacgggtgagtaacacgtgggaacgtgcccttcggttcggaataactcatggaaacgtgagctaataccggatacgcccttttggggaaaggtttactgccgaaggatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccatttaagtcgggggtgaaagcctgtggctcaaccacagaattgccttcgatactggatggcttgagaccggaagaggtaagtggaactgcgagtgtagaggtgaaattcgtagatattcgcaagaacaccagtggcgaaggcggcttactggtccggatctgacgctgaggcgcgaaagcgtggggagcaaacaggattagataccctggtagtccacgccgtaaacgatgaatgctagctgttggggtgcttgcacttcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtcctcttcggaggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacaatgggaagcgaaggggcgacctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaagggggcaggcgaccacggtagggtcagcgactggggtgaagtcgtaacaaggtagccgtaggggaacctgcggctggatcacctcctttcta

SEQ ID NO: 5598 - DNA, 1526 bp, Methylobacterium sp. 17Sr1-1
  ref <308>: DATABASE ACCESSION NUMBER: NCBI ACCESSION: NZ_CP029552.1
  ref <309>: DATABASE ENTRY DATE: 2019-04-01
  ref <313>: RELEVANT RESIDUES IN SEQ ID NO: (1)..(1526)
agcctccgttttagttgtgatcagctatgatcagctcttcaacttgagagtttgatcctggctcagagcgaacgctggcggcaggcttaacacatgcaagtcgagcgggcccttcggggtcagcggcagacgggtgagtaacgcgtgggaacgtgcccttcggttcggaataactcagggaaacttgagctaataccggatacgcccttttggggaaaggcttgactgccgaaggatcggcccgcgtctgattagctagttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggtctgcatgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcgtgttatccggagagatccggggtccccttcgggggcgcgcacacaggtgctgcatggctgtcgtcagctcgtgtcgtgagatgttgggttaagtcccgcaacgagcgcaacccacgtccctagttgccatcattcagttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5599 - DNA, 1540 bp, Methylobacterium sp. 17Sr1-28
  ref <308>: DATABASE ACCESSION NUMBER: NCBI ACCESSION: NZ_CP029553.1
  ref <309>: DATABASE ENTRY DATE: 2019-04-01
  ref <313>: RELEVANT RESIDUES IN SEQ ID NO: (1)..(1540)
gcttccgtttatgttgtgatcagctttgatcagctcttcaacttgagagtttgatcctggctcagagcgaacgctggcggcaggcttaacacatgcaagtcgagcgggcatccttgtggtgtcagcggcagacgggtgagtaacgcgtgggaacgtgcccttcggttcggaataactcagggaaacttgagctaataccggatacgtgcgagagcagaaaggtttatctgccgaaggatcggcccgcgtctgattagctagttggtgaggttatggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcgtgttacaccgagagatcggtggtccccttcgggggcgcgcacacaggtgctgcatggctgtcgtcagctcgtgtcgtgagatgttgggttaagtcccgcaacgagcgcaacccacgtcctcagttgccatcatttggttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgccaaggcaacttggtggaggcaggcgaccacggtagggtcagcgactggggtgaagtcgtaacaaggtagccgtaggggaacctgcggctggatcacctcctttcta

SEQ ID NO: 5600 - DNA, 1499 bp, Methylobacterium sp. 17Sr1-43
  ref <308>: DATABASE ACCESSION NUMBER: NCBI ACCESSION: NZ_CP029551.1
  ref <309>: DATABASE ENTRY DATE: 2019-04-01
  ref <313>: RELEVANT RESIDUES IN SEQ ID NO: (1)..(1499)
atgatcagctcttcaacttgagagtttgatcctggctcagagcgaacgctggcggcaggcttaacacatgcaagtcgaacgcatccttcggggtgagtggcagacgggtgagtaacacgtgggaacgtgccctccggttcgggataactcagggaaacgtgagctaataccggatacgtgcttaggcagaaaggtttactgccggaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgctgtaaacgatgaatgctagctgttggggtgcatgcaccgcagtagcgcagctaacgcattaagcattccgcctggggagtacggtcgcaagattaaaactcaaaggaattgacgggggcccgcacaagcggtggagcatgtggtttaattcgaagcaacgcgcagaaccttaccatcctttgacatggcaggcttgttccagagatggatcgttcccttcggggacctgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggggtgaccctgagccaatctccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5601 - DNA, 1491 bp, Methylobacterium sp. 190mf
  ref <308>: DATABASE ACCESSION NUMBER: NCBI ACCESSION: NZ_FNVI01000078.1
  ref <309>: DATABASE ENTRY DATE: 2019-04-01
  ref <313>: RELEVANT RESIDUES IN SEQ ID NO: (1)..(1491)
ctcttcaacgtgagagtttgatcctggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5602 - DNA, 1509 bp, Methylobacterium sp. 275MFSha3.1; identical to SEQ ID NO: 5596
  ref <308>: DATABASE ACCESSION NUMBER: NCBI ACCESSION: NZ_FNWP01000001.1
  ref <309>: DATABASE ENTRY DATE: 2019-04-01
  ref <313>: RELEVANT RESIDUES IN SEQ ID NO: (1)..(1509)

SEQ ID NO: 5603 - DNA, 1317 bp, Methylobacterium sp. 285MFTsu5.1
  ref <308>: DATABASE ACCESSION NUMBER: NCBI ACCESSION: NZ_KB911357.1
  ref <309>: DATABASE ENTRY DATE: 2019-04-01
  ref <313>: RELEVANT RESIDUES IN SEQ ID NO: (1)..(1317)
tggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaag

SEQ ID NO: 5604 - DNA, 1516 bp, Methylobacterium sp. 4-46
  ref <308>: DATABASE ACCESSION NUMBER: NCBI ACCESSION: NC_010511.1
  ref <309>: DATABASE ENTRY DATE: 2019-04-01
  ref <313>: RELEVANT RESIDUES IN SEQ ID NO: (1)..(1516)
ttgtgatcgagcgacgatcaactcttcaacttgagagtttgatcctggctcagagcgaacgctggcggcaggcttaacacatgcaagtcgagcgggcccctcggggtcagcggcagacgggtgagtaacgcgtgggaacgtgcccttcggttcggaataaccctgggaaactagggctaataccggatacgtccgtgaggagaaaggtttaccgccgaaggatcggcccgcgtctgattagcttgttggtgaggtaacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttacccgggacgataatgacggtaccgggtgaataagccccggctaacttcgtgccagcagccgcggtaatacgaagggggctagcgttgctcggaatcactgggcgtaaagggcgcgtaggcggcttgccaagtcgggggtgaaagcccgtggctcaaccacggaatggccttcgatactggcaggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcgtgctatggggagagatctccagttcccttcggggacgcgcacacaggtgctgcatggctgtcgtcagctcgtgtcgtgagatgttgggttaagtcccgcaacgagcgcaaccctcgcccttagttgccatcatttggttgggcactctagggggactgccggtgataagccgcgaggaaggtggggatgacgtcaagtcctcatggcccttacgggatgggctacacacgtgctacaatggcggtgacaatgggatgcgaaggggcgacctggagcaaatccccaaaagccgtctcagttcagattgcactctgcaactcgagtgcatgaaggcggaatcgctagtaatcgtggatcagcacgccacggtgaatacgttcccgggccttgtacacaccgcccgtcacaccatgggagttggtcttacccgacggcgctgcgccaaccgcgagggggcaggcgaccacggtagggtcagcgactggggtgaagtcgtaacaaggtagccgtaggggaacctgcggctggatcacctcctttctaagga

SEQ ID NO: 5605 - DNA, 1516 bp, Methylobacterium sp. 77
  ref <308>: DATABASE ACCESSION NUMBER: NCBI ACCESSION: NZ_KB910516.1
  ref <309>: DATABASE ENTRY DATE: 2019-04-01
  ref <313>: RELEVANT RESIDUES IN SEQ ID NO: (1)..(1516)
gtgacagctagatcaactcttcaacttgagagtttgatcctggctcagagcgaacgctggcggcaggcttaacacatgcaagtcgagcgggcaccttcgggtgtcagcggcagacgggtgagtaacacgtgggaacgtacccttcggttcggaataacgctgggaaactagcgctaataccggatacgcccttatggggaaaggtttactgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgttacccggagagattcggggtccacttcggtggcgtgcacacaggtgctgcatggctgtcgtcagctcgtgtcgtgagatgttgggttaagtcccgcaacgagcgcaacccacgtccttagttgccatcatttagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5606 - DNA, 1531 bp, Methylobacterium sp. 88A
  ref <308>: DATABASE ACCESSION NUMBER: NCBI ACCESSION: NZ_AQVT01000001.1
  ref <309>: DATABASE ENTRY DATE: 2019-04-01
  ref <313>: RELEVANT RESIDUES IN SEQ ID NO: (1)..(1531)
gcttccgttatgaagtgatcagctagatcaactcttcaacttgagagtttgatcctggctcagagcgaacgctggcggcaggcttaacacatgcaagtcgagcgggcatcttcggatgtcagcggcagacgggtgagtaacacgtgggaacgtacccttcggttcggaacaactctgggaaactggagctaataccggatacgcccttatggggaaaggtttactgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgtaatccggagagatccggggtccacttcggtggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaagggggcaggcgaccacggtgggatcggcgattgggacgaagtcgtaacaaggtagccgtaccggaaggtgcggctggatcacctcctttctaaggatgc

SEQ ID NO: 5607 - DNA, 1531 bp, Methylobacterium sp. AMS5
  ref <308>: DATABASE ACCESSION NUMBER: NCBI ACCESSION: NZ_CP006992.1
  ref <309>: DATABASE ENTRY DATE: 2019-04-01
  ref <313>: RELEVANT RESIDUES IN SEQ ID NO: (1)..(1531)
ctccgtttatgttgtgatcagctgagatcaactcttcaacttgagagtttgatcctggctcagagcgaacgctggcggcaggcttaacacatgcaagtcgaacgggcatcttcggatgtcagtggcagacgggtgagtaacacgtgggaacgtacccttcggttcggaataactcagggaaacttgagctaataccggatacgcccttttggggaaaggtttactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaagccgcgaggtggagcaaatccccaaaaaccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5608 - DNA, 1514 bp, Methylobacterium sp. ARG-1
  ref <308>: DATABASE ACCESSION NUMBER: NCBI ACCESSION: NZ_LHCD01000024.1
  ref <309>: DATABASE ENTRY DATE: 2019-04-01
  ref <313>: RELEVANT RESIDUES IN SEQ ID NO: (1)..(1514)
gtgatcagctttgatcaatctcttcaacgtgagagtttgatcctggctcagagcgaacgctggcggcaggcttaacacatgcaagtcgagcgggcccttcggggtcagcggcggacgggtgagtaacgcgtgggaacgtgccctctggttcggaataactcagggaaacttgagctaataccggatacgcccttttggggaaaggcttgctgccggaggatcggcccgcgtctgattagctagttggtgaggtaacggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcacctcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtcctcttcggaggcgcgcacacaggtgctgcatggctgtcgtcagctcgtgtcgtgagatgttgggttaagtcccgcaacgagcgcaacccacgtccttagttgccatcatttagttgggcactctagggagactgccggtgataagccgcgaggaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaagga

SEQ ID NO: 5609 - DNA, 1510 bp, Methylobacterium sp. B34
  ref <308>: DATABASE ACCESSION NUMBER: NCBI ACCESSION: NZ_BADE01000276.1
  ref <309>: DATABASE ENTRY DATE: 2019-04-01
  ref <313>: RELEVANT RESIDUES IN SEQ ID NO: (1)..(1510)
gtgatcggccagatcaatctcttcaacgtgagagtttgatcctggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaa

SEQ ID NO: 5610 - DNA, 1522 bp, Methylobacterium sp. B4
  ref <308>: DATABASE ACCESSION NUMBER: NCBI ACCESSION: NZ_QJJJ01000051.1
  ref <309>: DATABASE ENTRY DATE: 2019-04-01
  ref <313>: RELEVANT RESIDUES IN SEQ ID NO: (1)..(1522)
ctccgtttatgttgtgatcagccgagatcaactcttcaacttgagagtttgatcctggctcagagcgaacgctggcggcaggcttaacacatgcaagtcgaacgcatccttcgggatgagtggcagacgggtgagtaacacgtgggaacgtgcccttcggttcggaataactcagggaaacttgagctaataccggatacgcccttatggggaaaggttgaccgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacaatgggacgcgaaaccgcgaggttgagcaaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5611 - DNA, 1509 bp, Methylobacterium sp. C1
  ref <308>: DATABASE ACCESSION NUMBER: NCBI ACCESSION: NZ_CP017640.1
  ref <309>: DATABASE ENTRY DATE: 2019-04-01
  ref <313>: RELEVANT RESIDUES IN SEQ ID NO: (1)..(1509)
gtgatcggccagatcaatctcttcaacgtgagagtttgatcctggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5612 - DNA, 1503 bp, Methylobacterium sp. CCH5-D2
  ref <308>: DATABASE ACCESSION NUMBER: NCBI ACCESSION: NZ_LSIX01001091.1
  ref <309>: DATABASE ENTRY DATE: 2019-04-01
  ref <313>: RELEVANT RESIDUES IN SEQ ID NO: (1)..(1503)
atgatcagctcttcaacttgagagtttgatcctggctcagagcgaacgctggcggcaggcttaacacatgcaagtcgaacgcatccttcgggatgagtggcagacgggtgagtaacacgtgggaacgtgccctccggtctgggataaccctgggaaactagggctaataccggatacgtgctttggcagaaaggtttactgccggaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtctggtagaggttggtggaactgcgagtgtagaggtgaaattcgtagatattcgcaagaacaccggtggcgaaggcggccaactggaccagtactgacgctgaggcgcgaaagcgtggggagcaaacaggattagataccctggtagtccacgccgtaaacgatgaatgctagctgttggggtgcatgcaccgcagtagcgcagctaacgcattaagcattccgcctggggagtacggtcgcaagattaaaactcaaaggaattgacgggggcccgcacaagcggtggagcatgtggtttaattcgaagcaacgcgcagaaccttaccatcctttgacatggcacgttacctggagagatccagggtcctcttcggaggcgtgcacacaggtgctgcatggctgtcgtcagctcgtgtcgtgagatgttgggttaagtcccgcaacgagcgcaacccacgtcctcagttgccatcattcagttgggcactctggggagactgccggtgataagccgcgaggaaggtgtggatgacgtcaagtcctcatggcccttacgggatgggctacacacgtgctacaatggcggtgacagtgggacgcgaaggggtgaccctgagccaatctccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaagga

SEQ ID NO: 5613 - DNA, 1524 bp, Methylobacterium sp. DM1
  ref <308>: DATABASE ACCESSION NUMBER: NCBI ACCESSION: NZ_CP029173.1
  ref <309>: DATABASE ENTRY DATE: 2019-04-01
  ref <313>: RELEVANT RESIDUES IN SEQ ID NO: (1)..(1524)
ctccgtttatgttgtgatcagctgagatcaactcttcaacttgagagtttgatcctggctcagagcgaacgctggcggcaggcttaacacatgcaagtcgagcgggcaccttcgggtgtcagcggcagacgggtgagtaacacgtgggaacgtgcccttcggttcggaataactcagggaaacttgagctaataccggatacgcccttttggggaaaggtttactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggtctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaaccgcgaggttgagcaaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5614 - DNA, 1522 bp, Methylobacterium sp. GV094
  ref <308>: DATABASE ACCESSION NUMBER: NCBI ACCESSION: NZ_QJTP01000044.1
  ref <309>: DATABASE ENTRY DATE: 2019-04-01
  ref <313>: RELEVANT RESIDUES IN SEQ ID NO: (1)..(1522)
gcttccgttatgatgtgatcagctagatcaactcttcaacttgagagtttgatcctggctcagagcgaacgctggcggcaggcttaacacatgcaagtcgagcgggcccttcggggtcagcggcagacgggtgagtaacacgtgggaacgtaccctttggttcggaataacgctgggaaactagcgctaataccggatacgcccttttggggaaaggcttgctgccgaaggatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaacactgacgctgaggcgcgaaagcgtggggagcaaacaggattagataccctggtagtccacgccgtaaacgatgaatgctagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccatccggagagatccggggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaaccgcgaggttgagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5615 - DNA, 1522 bp, Methylobacterium sp. GV104; identical to SEQ ID NO: 5614
  ref <308>: DATABASE ACCESSION NUMBER: NCBI ACCESSION: NZ_QAYK01000046.1
  ref <309>: DATABASE ENTRY DATE: 2019-04-01
  ref <313>: RELEVANT RESIDUES IN SEQ ID NO: (1)..(1522)

SEQ ID NO: 5616 - DNA, 1513 bp, Methylobacterium sp. GXF4
  ref <308>: DATABASE ACCESSION NUMBER: NCBI ACCESSION: NZ_AKFK01000054.1
  ref <309>: DATABASE ENTRY DATE: 2019-04-01
  ref <313>: RELEVANT RESIDUES IN SEQ ID NO: (1)..(1513)
gtgatcagctttgatcaatctcttcaacgtgagagtttgatcctggctcagagcgaacgctggcggcaggcttacacatgcaagtcgagcgggcccttcggggtcagcggcggacgggtgagtaacgcgtgggaacgtgccctctggttcggaataactcagggaaacttgagctaataccggatacgcccttttggggaaaggcttgctgccggaggatcggcccgcgtctgattagctagttggtgaggtaacggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcacctcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttatggggagagattcccagtcctcttcggaggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaagga

SEQ ID NO: 5617 - DNA, 1497 bp, Methylobacterium sp. GXS13
  ref <308>: DATABASE ACCESSION NUMBER: NCBI ACCESSION: NZ_LKKO01000106.1
  ref <309>: DATABASE ENTRY DATE: 2019-04-01
  ref <313>: RELEVANT RESIDUES IN SEQ ID NO: (1)..(1497)
ctcttcaacgtgagagtttgatcctggctcagagcgaacgctggcggcaggcttaacacatgcaagtcgagcgggcaccttcgggtgtcagcggcggacgggtgagtaacgcgtgggaacgtgccctctggttcggaataactcagggaaacttgagctaataccggatacgcccttttggggaaaggcttgctgccggaggatcggcccgcgtctgattagctagttggtgaggtaacggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcacctcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacgtggagagattcacggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggggcgacctggagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaagga

SEQ ID NO: 5618 - DNA, 1532 bp, Methylobacterium sp. Leaf100
  ref <308>: DATABASE ACCESSION NUMBER: NCBI ACCESSION: NZ_LMMW01000012.1
  ref <309>: DATABASE ENTRY DATE: 2019-04-01
  ref <313>: RELEVANT RESIDUES IN SEQ ID NO: (1)..(1532)
gcttccgttatgatgtgatcggtctagatcaactcttcaacttgagagtttgatcctggctcagagcgaacgctggcggcaggcttaacacatgcaagtcgagcgggcaccttcgggtgtcagcggcagacgggtgagtaacacgtgggaacgtacccttcggttcggaataacgctgggaaactagcgctaataccggatacgcccttatggggaaaggtttactgccgaaggatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggcagaggtcagtggaactgcgagtgtagaggtgaaattcgtagatattcgcaagaacaccagtggcgaaggcggctgactgggccattactgacgctgaggcgcgaaagcgtggggagcaaacaggattagataccctggtagtccacgccgtaaacgatgaatgctagctgttggggtgcttgcaccgcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccagctggagagatccagggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaagcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5619 - DNA, 1532 bp, Methylobacterium sp. Leaf102
  ref <308>: DATABASE ACCESSION NUMBER: NCBI ACCESSION: NZ_LMMX01000034.1
  ref <309>: DATABASE ENTRY DATE: 2019-04-01
  ref <313>: RELEVANT RESIDUES IN SEQ ID NO: (1)..(1532)
gcttccgttatgatgtgatcggtctagatcaactcttcaacttgagagtttgatcctggctcagagcgaacgctggcggcaggcttaacacatgcaagtcgagcgggcaccttcgggtgtcagcggcagacgggtgagtaacacgtgggaacgtacccttcggttcggaataacgctgggaaactagcgctaataccggatacgcccttttggggaaaggtttactgccgaaggatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggcagaggtcagtggaactgcgagtgtagaggtgaaattcgtagatattcgcaagaacaccagtggcgaaggcggctgactgggccattactgacgctgaggcgcgaaagcgtggggagcaaacaggattagataccctggtagtccacgccgtaaacgatgaatgctagctgttggggtgcttgcaccgcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccagctggagagatccagggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaagcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5620 - DNA, 1531 bp, Methylobacterium sp. Leaf104
  ref <308>: DATABASE ACCESSION NUMBER: NCBI ACCESSION: NZ_LMMZ01000037.1
  ref <309>: DATABASE ENTRY DATE: 2019-04-01
  ref <313>: RELEVANT RESIDUES IN SEQ ID NO: (1)..(1531)
gcttccgttatgatgtgatcagctagatcaactcttcaacttgagagtttgatcctggctcagagcgaacgctggcggcaggcttaacacatgcaagtcgagcgggcactttcgggtgtcagcggcagacgggtgagtaacacgtgggaacgtaccctttggttcggaataacgctgggaaactagcgctaataccggatacgcccttttggggaaaggcttgctgccgaaggatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaatactgacgctgaggcgcgaaagcgtggggagcaaacaggattagataccctggtagtccacgccgtaaacgatgaatgctagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccatccggagagatccggggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaaccgcgaggtcgagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5621 - DNA, 1531 bp, Methylobacterium sp. Leaf106; identical to SEQ ID NO: 5595
  ref <308>: DATABASE ACCESSION NUMBER: NCBI ACCESSION: NZ_LMNB01000012.1
  ref <309>: DATABASE ENTRY DATE: 2019-04-01
  ref <313>: RELEVANT RESIDUES IN SEQ ID NO: (1)..(1531)

SEQ ID NO: 5622 - DNA, 1531 bp, Methylobacterium sp. Leaf108
  ref <308>: DATABASE ACCESSION NUMBER: NCBI ACCESSION: NZ_LMND01000012.1
  ref <309>: DATABASE ENTRY DATE: 2019-04-01
  ref <313>: RELEVANT RESIDUES IN SEQ ID NO: (1)..(1531)
gcttccgttatgatgtgatcggctagatcaactcttcaacttgagagtttgatcctggctcagagcgaacgctggcggcaggcttaacacatgcaagtcgagcgggcaccttcgggtgtcagcggcagacgggtgagtaacacgtgggaacgtacccttcggttcggaataactctgggaaactagagctaataccggatacgcccttttggggaaaggtttactgccgaaggatcggcccgcgtctgattagctagttggtggggtaatggcctaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggtagaggtcagtggaactgcgagtgtagaggtgaaattcgtagatattcgcaagaacaccagtggcgaaggcggctgactggaccattactgacgctgaggcgcgaaagcgtggggagcaaacaggattagataccctggtagtccacgccgtaaacgatgaatgctagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccagccggagagatccggggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaagggggcaggcgaccacggtagggtcagcgactggggtgaagtcgtaacaaggtagccgtaggggaacctgcggctggatcacctcctttctaaggatgc

SEQ ID NO: 5623 - DNA, 1529 bp, Methylobacterium sp. Leaf111
  ref <308>: DATABASE ACCESSION NUMBER: NCBI ACCESSION: NZ_LMNE01000045.1
  ref <309>: DATABASE ENTRY DATE: 2019-04-01
  ref <313>: RELEVANT RESIDUES IN SEQ ID NO: (1)..(1529)
gcttccgttatgatgtgatcagctagatcaactcttcaacttgagagtttgatcctggctcagagcgaacgctggcggcaggcttaacacatgcaagtcgagcgggcccttcggggtcagcggcagacgggtgagtaacacgtgggaacgtaccctttggttcggaataacgctgggaaactagcgctaataccggatacgcccttttggggaaaggcttgctgccgaaggatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaatactgacgctgaggcgcgaaagcgtggggagcaaacaggattagataccctggtagtccacgccgtaaacgatgaatgctagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccatccggagagatccggggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaaccgcgaggttgagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5624 - DNA, 1532 bp, Methylobacterium sp. Leaf112; identical to SEQ ID NO: 5619
  ref <308>: DATABASE ACCESSION NUMBER: NCBI ACCESSION: NZ_LMNG01000012.1
  ref <309>: DATABASE ENTRY DATE: 2019-04-01
  ref <313>: RELEVANT RESIDUES IN SEQ ID NO: (1)..(1532)

SEQ ID NO: 5625 - DNA, 1531 bp, Methylobacterium sp. Leaf113
  ref <308>: DATABASE ACCESSION NUMBER: NCBI ACCESSION: NZ_LMNJ01000045.1
  ref <309>: DATABASE ENTRY DATE: 2019-04-01
  ref <313>: RELEVANT RESIDUES IN SEQ ID NO: (1)..(1531)
gcttccgttatgatgtgatcagctagatcaactcttcaacttgagagtttgatcctggctcagagcgaacgctggcggcaggcttaacacatgcaagtcgagcgggcactttcgggtgtcagcggcagacgggtgagtaacacgtgggaacgtacccttcggttcggaataacgctgggaaactagcgctaataccggatacgcccttttggggaaaggtttactgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaatactgacgctgaggcgcgaaagcgtggggagcaaacaggattagataccctggtagtccacgccgtaaacgatgaatgctagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccatccggagagatccggggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaaccgcgaggttgagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5626 - DNA, 1531 bp, Methylobacterium sp. Leaf117; identical to SEQ ID NO: 5625
  ref <308>: DATABASE ACCESSION NUMBER: NCBI ACCESSION: NZ_LMNL01000036.1
  ref <309>: DATABASE ENTRY DATE: 2019-04-01
  ref <313>: RELEVANT RESIDUES IN SEQ ID NO: (1)..(1531)

SEQ ID NO: 5627 - DNA, 1531 bp, Methylobacterium sp. Leaf119
  ref <308>: DATABASE ACCESSION NUMBER: NCBI ACCESSION: NZ_LMNN01000014.1
  ref <309>: DATABASE ENTRY DATE: 2019-04-01
  ref <313>: RELEVANT RESIDUES IN SEQ ID NO: (1)..(1531)
ctccgtttatgttgtgatcagctgagatcaactcttcaacttgagagtttgatcctggctcagagcgaacgctggcggcaggcttaacacatgcaagtcgaacgggcaccttcgggtgtcagtggcagacgggtgagtaacacgtgggaacgtacccttcggttcggaataactcagggaaacttgagctaataccggatacgcccttttggggaaaggtttactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaagccgcgaggtggagcaaatccccaaaaaccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5628 - DNA, 1528 bp, Methylobacterium sp. Leaf121
  ref <308>: DATABASE ACCESSION NUMBER: NCBI ACCESSION: NZ_LMNP01000018.1
  ref <309>: DATABASE ENTRY DATE: 2019-04-01
  ref <313>: RELEVANT RESIDUES IN SEQ ID NO: (1)..(1528)
ctccgtttatgttgtgatcagctgagatcaactcttcaacttgagagtttgatcctggctcagagcgaacgctggcggcaggcttaacacatgcaagtcgaacgggcaccttcgggtgtcagtggcagacgggtgagtaacacgtgggaacgtacccttcggttcggaataactcagggaaacttgagctaataccggatacgcccttttggggaaaggtttactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaagccgcgaggtggagcaaatccccaaaaaccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaagga

SEQ ID NO: 5629 - DNA, 1531 bp, Methylobacterium sp. Leaf122
  ref <308>: DATABASE ACCESSION NUMBER: NCBI ACCESSION: NZ_LMNQ01000001.1
  ref <309>: DATABASE ENTRY DATE: 2019-04-01
  ref <313>: RELEVANT RESIDUES IN SEQ ID NO: (1)..(1531)
ctccgtttatgttgtgatcagctgagatcaactcttcaacttgagagtttgatcctggctcagagcgaacgctggcggcaggcttaacacatgcaagtcgaacgggcaccttcgggtgtcagtggcagacgggtgagtaacacgtgggaacgtacccttcggttcggaataactcagggaaacttgagctaataccggatacgcccttttggggaaaggtttactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcatttagttgggcactctagggagactgccggtgataagccgcgaggaaggtgtggatgacgtcaagtcctcatggcccttacgggatgggctacacacgtgctacaatggcggtgacagtgggacgcgaagccgcgaggtggagcaaatccccaaaaaccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5630 - DNA, 1531 bp, Methylobacterium sp. Leaf123
  ref <308>: DATABASE ACCESSION NUMBER: NCBI ACCESSION: NZ_LMNS01000034.1
  ref <309>: DATABASE ENTRY DATE: 2019-04-01
  ref <313>: RELEVANT RESIDUES IN SEQ ID NO: (1)..(1531)
ctccgtttatgttgtgatcagctgagatcaactcttcaacttgagagtttgatcctggctcagagcgaacgctggcggcaggcttaacacatgcaagtcgaacgggcaycttcggrtgtcagtggcagacgggtgagtaacacgtgggaacgtacccttcggttcggaataactcagggaaacttgagctaataccggatacgcccttttggggaaaggtttactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaagccgcgaggtggagcaaatccccaaaaaccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5631 - DNA, 1529 bp, Methylobacterium sp. Leaf125
  ref <308>: DATABASE ACCESSION NUMBER: NCBI ACCESSION: NZ_LMNU01000023.1
  ref <309>: DATABASE ENTRY DATE: 2019-04-01
  ref <313>: RELEVANT RESIDUES IN SEQ ID NO: (1)..(1529)
gcttccgttatgatgtgatcagctagatcaactcttcaacttgagagtttgatcctggctcagagcgaacgctggcggcaggcttaacacatgcaagtcgagcgggcccttcggggtcagcggcagacgggtgagtaacacgtgggaacgtaccctttggttcggaataacgctgggaaactagcgctaataccggatacgcccttttggggaaaggcttgctgccgaaggatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaacactgacgctgaggcgcgaaagcgtggggagcaaacaggattagataccctggtagtccacgccgtaaacgatgaatgctagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccatccggagagatccggggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaaccgcgaggttgagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5632 - DNA, 1481 bp, Methylobacterium sp. Leaf361
  ref <308>: DATABASE ACCESSION NUMBER: NCBI ACCESSION: NZ_LMPY01000078.1
  ref <309>: DATABASE ENTRY DATE: 2019-04-01
  ref <313>: RELEVANT RESIDUES IN SEQ ID NO: (1)..(1481)
gtgatcggccagatcaatctcttcaacgtgagagtttgatcctggctcagagcgaacgctggcggcaggcttaacacatgcaagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacrcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccgggtcagcgactggggtgaagtcgtaacaaggtagccgtaggggaacctgcggctggatcacctcctttcta

SEQ ID NO: 5633 - DNA, 1531 bp, Methylobacterium sp. Leaf399; identical to SEQ ID NO: 5622
  ref <308>: DATABASE ACCESSION NUMBER: NCBI ACCESSION: NZ_LMQK01000012.1
  ref <309>: DATABASE ENTRY DATE: 2019-04-01
  ref <313>: RELEVANT RESIDUES IN SEQ ID NO: (1)..(1531)

SEQ ID NO: 5634 - DNA, 1533 bp, Methylobacterium sp. Leaf456
  ref <308>: DATABASE ACCESSION NUMBER: NCBI ACCESSION: NZ_LMQV01000041.1
  ref <309>: DATABASE ENTRY DATE: 2019-04-01
  ref <313>: RELEVANT RESIDUES IN SEQ ID NO: (1)..(1533)
ctccgtttatgttgtgatcagctgagatctaactcttcaacttgagagtttgatcctggctcagagcgaacgctggcggcaggcttaacacatgcaagtcgagcgggcatccttgtggtgtcagcggcagacgggtgagtaacacgtgggaacgtacccttcggttcggaataactcagggaaacttgagctaataccggatacgcccttttggggaaaggtttactgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggctttttaagtcgggggtgaaagcctgtggctcaaccacagaattgccttcgatactggaaagcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcgtgttacccagggagacttgggatcctcttcggaggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaaccgcgaggttgagcaaatccccaaaagccgtctcagttcggattgcactctgcaactcgggtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5635 - DNA, 1529 bp, Methylobacterium sp. Leaf465; identical to SEQ ID NO: 5623
  ref <308>: DATABASE ACCESSION NUMBER: NCBI ACCESSION: NZ_LMRA01000045.1
  ref <309>: DATABASE ENTRY DATE: 2019-04-01
  ref <313>: RELEVANT RESIDUES IN SEQ ID NO: (1)..(1529)

SEQ ID NO: 5636 - DNA, 1531 bp, Methylobacterium sp. Leaf466; identical to SEQ ID NO: 5622
  ref <308>: DATABASE ACCESSION NUMBER: NCBI ACCESSION: NZ_LMRC01000031.1
  ref <309>: DATABASE ENTRY DATE: 2019-04-01
  ref <313>: RELEVANT RESIDUES IN SEQ ID NO: (1)..(1531)

SEQ ID NO: 5637 - DNA, 1532 bp, Methylobacterium sp. Leaf469
  ref <308>: DATABASE ACCESSION NUMBER: NCBI ACCESSION: NZ_LMRE01000012.1
  ref <309>: DATABASE ENTRY DATE: 2019-04-01
  ref <313>: RELEVANT RESIDUES IN SEQ ID NO: (1)..(1532)
gcttccgttatgatgtgatcggtctagatcaactcttcaacttgagagtttgatcctggctcagagcgaacgctggcggcaggcttaacacatgcaagtcgagcgggcacyttcgggtgtcagcggcagacgggtgagtaacacgtgggaacgtacccttcggttcggaataacgctgggaaactagcgctaataccggatacgcccttatggggaaaggtttactgccgaaggatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggcagaggtcagtggaactgcgagtgtagaggtgaaattcgtagatattcgcaagaacaccagtggcgaaggcggctgactgggccattactgacgctgaggcgcgaaagcgtggggagcaaacaggattagataccctggtagtccacgccgtaaacgatgaatgctagctgttggggtgcttgcaccgcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccagctggagagatccagggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaagcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5638 - DNA, 1531 bp, Methylobacterium sp. Leaf85
  ref <308>: DATABASE ACCESSION NUMBER: NCBI ACCESSION: NZ_LMME01000012.1
  ref <309>: DATABASE ENTRY DATE: 2019-04-01
  ref <313>: RELEVANT RESIDUES IN SEQ ID NO: (1)..(1531)
gcttccgttatgaagtgatcagctagatcaactcttcaacttgagagtttgatcctggctcagagcgaacgctggcggcaggcttaacacatgcaagtcgagcgggcattttcggatgtcagcggcagacgggtgagtaacacgtgggaacgtacccttcggttcggaacaactctgggaaactggagctaataccggatacgcccttatggggaaaggtttactgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgtaatccggagagatccggggtccacttcggtggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaagggggcaggcgaccacggtagggtcagcgactggggtgaagtcgtaacaaggtagccgtaggggaacctgcggctggatcacctcctttctaaggatgc

SEQ ID NO: 5639 - DNA, 1531 bp, Methylobacterium sp. Leaf86
  ref <308>: DATABASE ACCESSION NUMBER: NCBI ACCESSION: NZ_LMMG01000030.1
  ref <309>: DATABASE ENTRY DATE: 2019-04-01
  ref <313>: RELEVANT RESIDUES IN SEQ ID NO: (1)..(1531)
gcttccgttatgaagtgatcagctagatcaactcttcaacttgagagtttgatcctggctcagagcgaacgctggcggcaggcttaacacatgcaagtcgagcgggcatcttcggatgtcagcggcagacgggtgagtaacacgtgggaacgtacccttcggttcggaataacgctgggaaactagcgctaataccggatacgcccttttggggaaaggtttactgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgttacccggagagattcggggtccacttcggtggcgtgcacacaggtgctgcatggctgtcgtcagctcgtgtcgtgagatgttgggttaagtcccgcaacgagcgcaacccacgtccttagttgccatcatttagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5640 - DNA, 1532 bp, Methylobacterium sp. Leaf87; identical to SEQ ID NO: 5619
  ref <308>: DATABASE ACCESSION NUMBER: NCBI ACCESSION: NZ_LMMI01000001.1
  ref <309>: DATABASE ENTRY DATE: 2019-04-01
  ref <313>: RELEVANT RESIDUES IN SEQ ID NO: (1)..(1532)

SEQ ID NO: 5641 - DNA, 1529 bp, Methylobacterium sp. Leaf88; identical to SEQ ID NO: 5623
  ref <308>: DATABASE ACCESSION NUMBER: NCBI ACCESSION: NZ_LMMK01000040.1
  ref <309>: DATABASE ENTRY DATE: 2019-04-01
  ref <313>: RELEVANT RESIDUES IN SEQ ID NO: (1)..(1529)

SEQ ID NO: 5642 - DNA, 1529 bp, Methylobacterium sp. Leaf89; identical to SEQ ID NO: 5623
  ref <308>: DATABASE ACCESSION NUMBER: NCBI ACCESSION: NZ_LMML01000021.1
  ref <309>: DATABASE ENTRY DATE: 2019-04-01
  ref <313>: RELEVANT RESIDUES IN SEQ ID NO: (1)..(1529)

SEQ ID NO: 5643 - DNA, 1532 bp, Methylobacterium sp. Leaf90
  ref <308>: DATABASE ACCESSION NUMBER: NCBI ACCESSION: NZ_LMMN01000003.1
  ref <309>: DATABASE ENTRY DATE: 2019-04-01
  ref <313>: RELEVANT RESIDUES IN SEQ ID NO: (1)..(1532)
ctccgtttatgttgtgatcagctgagatcaactcttcaacttgagagtttgatcctggctcagagcgaaacgctggcggcaggcttaacacatgcaagtcgaacgggcaccttcgggtgtcagtggcagacgggtgagtaacacgtgggaacgtacccttcggttcggaataactcagggaaacttgagctaataccggatacgcccttttggggaaaggtttactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaagccgcgaggtggagcaaatccccaaaaaccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5644 - DNA, 1531 bp, Methylobacterium sp. Leaf91
  ref <308>: DATABASE ACCESSION NUMBER: NCBI ACCESSION: NZ_LMMP01000052.1
  ref <309>: DATABASE ENTRY DATE: 2019-04-01
  ref <313>: RELEVANT RESIDUES IN SEQ ID NO: (1)..(1531)
gcttccgttatgaagtgatcagctagatcaactcttcaacttgagagtttgatcctggctcagagcgaacgctggcggcaggcttaacacatgcaagtcgagcgggcatcttcggatgtcagcggcagacgggtgagtaacacgtgggaacgtacccttcggttcggaataacgctgggaaactagcgctaataccggatacgcccttttggggaaaggtttactgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccrttcaagtcgggggtgaaagcctgtggctcaaccacagaattgccttcgatactgtttggcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgttacccggagagattcggggtccacttcggtggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaaggatgc

SEQ ID NO: 5645 - DNA, 1531 bp, Methylobacterium sp. Leaf92; identical to SEQ ID NO: 5629
  ref <308>: DATABASE ACCESSION NUMBER: NCBI ACCESSION: NZ_LMMQ01000036.1
  ref <309>: DATABASE ENTRY DATE: 2019-04-01
  ref <313>: RELEVANT RESIDUES IN SEQ ID NO: (1)..(1531)

SEQ ID NO: 5646 - DNA, 1531 bp, Methylobacterium sp. Leaf93
  ref <308>: DATABASE ACCESSION NUMBER: NCBI ACCESSION: NZ_LMMS01000001.1
  ref <309>: DATABASE ENTRY DATE: 2019-04-01
  ref <313>: RELEVANT RESIDUES IN SEQ ID NO: (1)..(1531)
gcttccgttatgaagtgatcagctagatcaactcttcaacttgagagtttgatcctggctcagagcgaacgctggcggcaggcttaacacatgcaagtcgagcgggcatcttcggatgtcagcggcagacgggtgagtaacacgtgggaacgtacccttcggttcggaacaactctgggaaactggagctaataccggatacgcccttttggggaaaggtttactgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcatgtaatccggagagatccggggtccacttcggtggcgtgcacacaggtgctgcatggctgtcgtcagctcgtgtcgtgagatgttgggttaagtcccgcaacgagcgcaacccacgtccttagttgccatcatttagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaagggggcaggcgaccacggtagggtcagcgactggggtgaagtcgtaacaaggtagccgtaggggaacctgcggctggatcacctcctttctaaggatgc

SEQ ID NO: 5647 - DNA, 1529 bp, Methylobacterium sp. Leaf94; identical to SEQ ID NO: 5623
  ref <308>: DATABASE ACCESSION NUMBER: NCBI ACCESSION: NZ_LMRM01000023.1
  ref <309>: DATABASE ENTRY DATE: 2019-04-01
  ref <313>: RELEVANT RESIDUES IN SEQ ID NO: (1)..(1529)

SEQ ID NO: 5648 - DNA, 1529 bp, Methylobacterium sp. Leaf99
  ref <308>: DATABASE ACCESSION NUMBER: NCBI ACCESSION: NZ_LMMU01000001.1
  ref <309>: DATABASE ENTRY DATE: 2019-04-01
  ref <313>: RELEVANT RESIDUES IN SEQ ID NO: (1)..(1529)
gcttccgttatgatgtgatcggtctagatcaactcttcaacttgagagtttgatcctggctcagagcgaacgctggcggcaggcttaacacatgcaagtcgagcgggcaccttcgggtgtcagcggcagacgggtgagtaacacgtgggaacgtacccttcggttcggaataacgcatggaaacgtgcgctaataccggatacgcccttttggggaaaggcttgctgccgaaggatcggcccgcgtctgattagctagttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtatggtagaggtcagtggaactgcgagtgtagaggtgaaattcgtagatattcgcaagaacaccagtggcgaaggcggctgactggaccattactgacgctgaggcgcgaaagcgtggggagcaaacaggattagataccctggtagtccacgccgtaaacgatgaatgctagctgttggggtgcttgcaccgcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccatccggagagatccggggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaagga

SEQ ID NO: 5649 - DNA, 777 bp, Methylobacterium sp. MIMD6
  ref <308>: DATABASE ACCESSION NUMBER: NCBI ACCESSION: NZ_QOWC01000486.1
  ref <309>: DATABASE ENTRY DATE: 2019-04-01
  ref <313>: RELEVANT RESIDUES IN SEQ ID NO: (1)..(777)
agcttccgttcatgttgtgatcagcgatgatcaactcttcaacttgagagtttgatcctggctcagagcgaacgctggcggcaggcttaacacatgcaagtcgagcgggcccttcggggtcagcggcagacgggtgagtaacacgtgggaacgtaccctttggttcggaacaaccctgggaaactagggctaataccggatacgtccgagaggagaaaggtttatccgccgagggatcggcccgcgtctgattagctagttggtgaggtaacggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcggaggtgaaagcccgtggctcaaccacggaatggccttcgatactggtcggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagata

SEQ ID NO: 5650 - DNA, 1525 bp, Methylobacterium sp. TER-1
  ref <308>: DATABASE ACCESSION NUMBER: NCBI ACCESSION: NZ_SACP01000058.1
  ref <309>: DATABASE ENTRY DATE: 2019-04-01
  ref <313>: RELEVANT RESIDUES IN SEQ ID NO: (1)..(1525)
gcttccgttatgttgtgatcagctaagatcattctcttcaacttgagagtttgatcctggctcagagcgaacgctggcggcaggcttaacacatgcaagtcgagcgggcccttcggggtcagcggcagacgggtgagtaacgcgtgggaacgtaccctttggttcggaataaccctgggaaactagggctaataccggataagcccttttggggaaaggtttactgccgaaggatcggcccgcgtctgattagcttgttggtggggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggcttgacaagtcgagggtgaaagcctgtggctcaaccacagaattgccttcgatactgttaggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgctagccgttggtccgcttgcggatcagtggcgccgctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgcaatccggagagatccggggttcccttcggggacgcgaacacaggtgctgcatggctgtcgtcagctcgtgtcgtgagatgttgggttaagtcccgcaacgagcgcaaccctcgcccttagttgccatcattcagttgggcactctagggggactgccggtgataagccgagaggaaggtggggatgacgtcaagtcctcatggcccttacgggatgggctacacacgtgctacaatggcggtgacaatgggatgcgaaagggcgacctgaagcaaatccccaaaaaccgtctcagttcagattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttctaa

SEQ ID NO: 5651 - DNA, 1317 bp, Methylobacterium sp. UNC300MFChir4.1; identical to SEQ ID NO: 5603
  ref <308>: DATABASE ACCESSION NUMBER: NCBI ACCESSION: NZ_FOCS01000073.1
  ref <309>: DATABASE ENTRY DATE: 2019-04-01
  ref <313>: RELEVANT RESIDUES IN SEQ ID NO: (1)..(1317)

SEQ ID NO: 5652 - DNA, 1509 bp, Methylobacterium sp. UNCCL110
  ref <308>: DATABASE ACCESSION NUMBER: NCBI ACCESSION: NZ_JQJG01000132.1
  ref <309>: DATABASE ENTRY DATE: 2019-04-01
  ref <313>: RELEVANT RESIDUES IN SEQ ID NO: (1)..(1509)
gtgatcggccagatcaatctcttcaacgtgagagtttgatcctggctcagagcgaacgctggcggcaggcttaacacatgcaagtcgagcggacctttcggggtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5653 - DNA, 1479 bp, Methylobacterium sp. UNCCL125
  ref <308>: DATABASE ACCESSION NUMBER: NCBI ACCESSION: NZ_FPBW01000001.1
  ref <309>: DATABASE ENTRY DATE: 2019-04-01
  ref <313>: RELEVANT RESIDUES IN SEQ ID NO: (1)..(1479)
agagtttgatcctggctcagagcgaacgctggcggcaggcttaacacatgcaagtcgagcggacctttcggggtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5654 - DNA, 1080 bp, Methylobacterium sp. V23
  ref <308>: DATABASE ACCESSION NUMBER: NCBI ACCESSION: NZ_PDHT01000132.1
  ref <309>: DATABASE ENTRY DATE: 2019-04-01
  ref <313>: RELEVANT RESIDUES IN SEQ ID NO: (1)..(1080)
ccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaacactgacgctgaggcgcgaaagcgtggggagcaaacaggattagataccctggtagtccacgccgtaaacgatgaatgctagctgttggggtgcttgcacctcagtagcgcagctaacgctttaagcattccgcctggggagtacggtcgcaagattaaaactcaaaggaattgacgggggcccgcacaagcggtggagcatgtggtttaattcgaagcaacgcgcagaaccttaccatcccttgacatgtcgtgccatccggagagatccggggttcccttcggggacgcgaacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaaccgcgaggttgagcaaatccccaaaaaccgtctcagttcagattgcactctgcaactcgagtgcatgaaggcggaatcgctagtaatcgtggatcagcatgccacggtgaatacgttcccgggccttgtacacaccgcccgtcacaccatggg

SEQ ID NO: 5655 - DNA, 1516 bp, Methylobacterium sp. WSM2598
  ref <308>: DATABASE ACCESSION NUMBER: NCBI ACCESSION: NZ_KB900609.1
  ref <309>: DATABASE ENTRY DATE: 2019-04-01
  ref <313>: RELEVANT RESIDUES IN SEQ ID NO: (1)..(1516)
ttgtgatcgagcgacgatcaactcttcaacttgagagtttgatcctggctcagagcgaacgctggcggcaggcttaacacatgcaagtcgagcgggcccctcggggtcagcggcagacgggtgagtaacgcgtgggaacgtgcccttcggttcggaataaccctgggaaactagggctaataccggatacgtccgtgaggagaaaggtttaccgccgaaggatcggcccgcgtctgattagcttgttggtgaggtaacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttacccgggacgataatgacggtaccgggtgaataagccccggctaacttcgtgccagcagccgcggtaatacgaagggggctagcgttgctcggaatcactgggcgtaaagggcgcgtaggcggcttgccaagtcgggggtgaaagcccgtggctcaaccacggaatggccttcgatactggcaggcttgagaccggaagagggcagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgctagccgttggggtgcatgcacctcagtggcgccgctaacgctttaagcattccgcctggggagtacggtcgcaagattaaaactcaaaggaattgacgggggcccgcacaagcggtggagcatgtggtttaattcgaagcaacgcgcagaaccttaccatcccttgacatggcgtgctacgcggagagatccgcggttcccttcggggacgcgcacacaggtgctgcatggctgtcgtcagctcgtgtcgtgagatgttgggttaagtcccgcaacgagcgcaaccctcgcccttagttgccatcatttggttgggcactctagggggactgccggtgataagccgcgaggaaggtggggatgacgtcaagtcctcatggcccttacgggatgggctacacacgtgctacaatggcggtgacaatgggatgcgaaggggcgacctggagcaaatccccaaaagccgtctcagttcagattgcactctgcaactcgagtgcatgaaggcggaatcgctagtaatcgtggatcagcacgccacggtgaatacgttcccgggccttgtacacaccgcccgtcacaccatgggagttggtcttacccgacggcgctgcgccaaccgcaagggggcaggcgaccacggtagggtcagcgactggggtgaagtcgtaacaaggtagccgtaggggaacctgcggctggatcacctcctttctaagga

SEQ ID NO: 5656 - DNA, 1509 bp, Methylobacterium sp. XJLW; identical to SEQ ID NO: 5652
  ref <308>: DATABASE ACCESSION NUMBER: NCBI ACCESSION: NZ_CP016429.1
  ref <309>: DATABASE ENTRY DATE: 2019-04-01
  ref <313>: RELEVANT RESIDUES IN SEQ ID NO: (1)..(1509)

SEQ ID NO: 5657 - DNA, 1501 bp, Methylobacterium sp. ZNC0032
  ref <308>: DATABASE ACCESSION NUMBER: NCBI ACCESSION: NZ_JROW01000217.1
  ref <309>: DATABASE ENTRY DATE: 2019-04-01
  ref <313>: RELEVANT RESIDUES IN SEQ ID NO: (1)..(1501)
tcattcaatctgagagtttgatcctggctcagagcgaacgctggcggcaggcttaacacatgcaagtcgaacgggcacttcggtgctagtggcagacgggtgagtaacgcgtgggaacgtgcctttcggttcggaataatccagggaaacttggactaataccggatacgcccttcgggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgggagtcttgagttcggaagaggttggtggaactgcgagtgtagaggtgaaattcgtagatattcgcaagaacaccggtggcgaaggcggccaactggtccgaaactgacgctgaggcgcgaaagcgtggggagcaaacaggattagataccctggtagtccacgccgtaaacgatgaatgccagccgttggggagcttgctcttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgtactctgcaactcgagtacatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtag

SEQ ID NO: 5658 - DNA, 1317 bp, Methylobacterium sp. yr668; identical to SEQ ID NO: 5603
  ref <308>: DATABASE ACCESSION NUMBER: NCBI ACCESSION: NZ_FOZY01000099.1
  ref <309>: DATABASE ENTRY DATE: 2019-04-01
  ref <313>: RELEVANT RESIDUES IN SEQ ID NO: (1)..(1317)

SEQ ID NO: 5659 - DNA, 1365 bp, Methylobacterium tarhaniae
  ref <308>: DATABASE ACCESSION NUMBER: NCBI ACCESSION: NZ_LABZ01000065.1
  ref <309>: DATABASE ENTRY DATE: 2019-04-01
  ref <313>: RELEVANT RESIDUES IN SEQ ID NO: (1)..(1365)
gaataactcagggaaacttgagctaataccggatacgcccttctggggaaaggcttgctgccgaaggatcggcccgcgtctgattagctggttggtgaggttatggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggctgatttagtcgagggtgaaagcccgtggctcaaccacggaatggccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgttggggtgcatgcacctcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgcgagctagagagatctagtgtcctcttcggaggcgtgcacacaggtgctgcatggctgtcgtcagctcgtgtcgtgagatgttgggttaagtcccgcaacgagcgcaacccacgtccctagttgccatcattgagttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcgagggggcaggcgaccacggtagggtcagcgactggggtgaagtcgtaacaaggtagccgtaggggaacctgcggctggatcacctcctttctaaggatgc

SEQ ID NO: 5660 - DNA, 1534 bp, Methylobacterium variabile
  ref <308>: DATABASE ACCESSION NUMBER: NCBI ACCESSION: NZ_LABY01000145.1
  ref <309>: DATABASE ENTRY DATE: 2019-04-01
  ref <313>: RELEVANT RESIDUES IN SEQ ID NO: (1)..(1534)
gcttccgtttatgttgtgatcagctttgatcagctcttcaacttgagagtttgatcctggctcagagcgaacgctggcggcaggcttaacacatgcaagtcgagcgggcatccttgtggtgtcagcggcagacgggtgagtaacgcgtgggaacgtgcccttcggttcggaataactcagggaaacttgagctaataccggatacgcccttctggggaaaggcttgctgccgaaggatcggcccgcgtctgattagctggttggtgaggttacggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaatacgaagggggctagcgttgctcggaatcactgggcgtaaagggcgcgtaggcggttttttaagtcgggggtgaaagcctgtggctcaaccacagaatggccttcgatactggaagacttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgctgtaaacgatgaatgctagccgtaggggtgcatgcacctctgtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcgtgttatccggagagatccggggtccccttcgggggcgcgcacacaggtgctgcatggctgtcgtcagctcgtgtcgtgagatgttgggttaagtcccgcaacgagcgcaacccacgtcctcagttgccatcatttggttgggcactctggggagactgccggtgataagccgcgaggaaggtgtggatgacgtcaagtcctcatggcccttacgggatgggctacacacgtgctacaatggcggtgacaatgggcagcgaaggggcgacctggagcgaatccccaaaagccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaagggggcaggcgaccacggtagggtcagcgactggggtgaagtcgtaacaaggtagccgtaggggaacctgcggctggatcacctcctttctaaggatgc

SEQ ID NO: 5661 - DNA, 1542 bp, Methylocaldum marinum
  ref <308>: DATABASE ACCESSION NUMBER: NCBI ACCESSION: NZ_AP017928.1
  ref <309>: DATABASE ENTRY DATE: 2019-04-01
  ref <313>: RELEVANT RESIDUES IN SEQ ID NO: (1)..(1542)
taaactgaagagtttgatcatggctcagattgaacgctggcggcatgcttaacacatgcaagtcgaacggcagcacagccgggtaaccggtgggtggcgagtggcggacgggtgagtaatgcgtaggaatctgccttgtagtgggggataacccggggaaactcgggctaataccgcatacgttctacggaggaaagcgggggatcttcggacctcgcgctatgagatgagcctacgtccgattagctagttggtagggtaatggcctaccaaggcgacgatcggtagctggtctgagaggacgatcagccacactggaactgagacacggtccagactcctacgggaggcagcagtggggaatattggacaatgggcgcaagcctgatccagcaatgccgcgtgtgtgaagaaggcctgcgggttgtaaagcactttaagcggggaagaaaggtggggtgttaataccatctcacattgacgttacctgcagaataagcaccggctaactccgtgccagcagccgcggtaatacggagggtgcgagcgttaatcggaattactgggcgtaaagcgcgcgtaggcggtttgttaagtcagctgtgaaagccccgggcttaacctgggaatggcagttgatactggcaggctagagtgtggtagaggggtgtggaatttccggtgtagcagtgaaatgcgtagagatcggaaggaacaccagtggcgaaggcggcaccctggaccgacactgacgctgaggtgcgaaagcgtggggagcaaacaggattagataccctggtagtccacgctgtaaacgatgagaactagccgttgggcacaattgagtgtttagtggcgcagctaacgcgataagttctccgcctggggagtacggccgcaaggttaaaactcaaatgaattgacgggggcccgcacaagcggtggagcatgtggtttaattcgatgcaacgcgaagaaccttacctggtcttgacatcttaggaacccttgagagattgaggggtgccttcgggagcctaaagacaggtgctgcatggctgtcgtcagctcgtgtcgtgagatgttgggttaagtcccgtaacgagcgcaacccttgtccctagttgccagcgttaagtcgggaactctagggagactgccggtgataaaccggaggaaggtggggatgacgtcaagtcatcatggcccttatgaccagggctacacacgtgctacaatggtcggtacagagggtagccaagccgcgaggcggagccaatctcacaaagccgatcgtagtccggattgcagtctgcaactcgactgcatgaagtcggaatcgctagtaatcgcggatcagcatgccgcggtgaatacgttcccgggccttgtacacaccgcccgtcacaccatgggagtgggttgcaccagaagcaggtagtctaaccttcgggagggcgcttgccacggtgtggttcatgactggggtgaagtcgtaacaaggtagccgtaggggaacctgcggctggatcacctcctttc

SEQ ID NO: 5662 - DNA, 1495 bp, Methylocapsa acidiphila
  ref <308>: DATABASE ACCESSION NUMBER: NCBI ACCESSION: NZ_KE386496.1
  ref <309>: DATABASE ENTRY DATE: 2019-04-01
  ref <313>: RELEVANT RESIDUES IN SEQ ID NO: (1)..(1495)
tcattcaacttgagagtttgatcctggctcagaacgaacgctggcggcaggcctaacacatgcaagtcgaacgccccgcaaggggagtggcagacgggtgagtaacgcgtgggaacatacccttcggttcggaatagctcagggaaacttggattaataccggatacgtccgcaaggagaaagatttatcgccgaaggattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccttagggttgtaaagctcttttacctgggaagataatgacggtaccaggagaataagccccggctaacttcgtgccagcagccgcggtaatacgaagggggctagcgttgttcggatttactgggcgtaaagcgcacgtaggcggatctttaagtcaggggtgaaatcccggggctcaacctcggaactgcctttgatactggagatcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacaggattagataccctggtagtccacgccgtaaacgatggatgctagccgttaggcagcttgctgcttagtggcgcagttaacgctttaagcatcccgcctggggagtacggtcgcaagattaaaactcaaaggaattgacgggggcccgcacaagcggtggagcatgtggtttaattcgaagcaacgcgcagaaccttaccagctcttgacatgccttggacggttaccagagatggtttcctctcttcggagccagggacacaggtgctgcatggctgtcgtcagctcgtgtcgtgagatgttgggttaagtcccgcaacgagcgcaaccctcgcccttagttgccatcatttagttgggcactctagggggactgccggtgataagccgagaggaaggtggggatgacgtcaagtcctcatggcccttacgggctgggctacacacgtgctacaatggcggtgacaatgggacgcaaaggggtgacccctagcaaatctcaaaaagccgtctcagttcggattgcactctgcaactcgagtgcatgaaggtggaatcgctagtaatcgtagatcagaacgctacggtgaatacgttcccgggccttgtacacaccgcccgtcacaccatgggagttggttctacccgaaggcgttttgctaaccgcaagggggcaggcgaccacggtagggtcagcgactggggtgaagtcgtaacaaggtagccgtaggggaacctgcggctggatcacctcctttctaagga

SEQ ID NO: 5663 - DNA, 1499 bp, Methylocapsa aurea
  ref <308>: DATABASE ACCESSION NUMBER: NCBI ACCESSION: NZ_JQKO01000009.1
  ref <309>: DATABASE ENTRY DATE: 2019-04-01
  ref <313>: RELEVANT RESIDUES IN SEQ ID NO: (1)..(1499)
tcattcaacttgagagtttgatcctggctcagaacgaacgctggcggcaggcctaacacatgcaagtcgaacgccgtagcaatacggagtggcagacgggtgagtaacacgtgggaacatacccttcggttcggaataactcagggaaacttgtgctaataccggatacgtccgcaaggagaaagatttatcgccgaaggattggcccgcgtctgattagcttgttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccttagggttgtaaagctcttttacctgggaagataatgacggtaccaggagaataagccccggctaacttcgtgccagcagccgcggtaatacgaagggggctagcgttgttcggatttactgggcgtaaagcgcacgtaggcggatctttaagtcaggggtgaaatcccggggctcaacctcggaactgcctttgatactggagatcttgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttaggcagcttgctgcttagtggcgcagttaacgctttaagcatcccgcctggggagtacggtcgcaagattaaaactcaaaggaattgacgggggcccgcacaagcggtggagcatgtggtttaattcgaagcaacgcgcagaaccttaccagctcttgacatgtctcgtttggttaccagagatggtttccttcacttcgggtggcgagaacacaggtgctgcatggctgtcgtcagctcgtgtcgtgagatgttgggttaagtcccgcaacgagcgcaaccctcgcccttagttgccatcatttagttgggcactctagggggactgccggtgataagccgagaggaaggtggggatgacgtcaagtcctcatggcccttacgggctgggctacacacgtgctacaatggcggtgacagtgggacgcgaaggggtgaccccgagcaaatctcaaaaagccgtctcagttcggattgcactctgcaactcgagtgcatgaaggtggaatcgctagtaatcgtagatcagaacgctacggtgaatacgttcccgggccttgtacacaccgcccgtcacaccatgggagttggttctacccgaaggcgttttgctaaccgcaaggaggcaggcgaccacggtagggtcagcgactggggtgaagtcgtaacaaggtagccgtaggggaacctgcggctggatcacctcctttctaagga

SEQ ID NO: 5664 - DNA, 1498 bp, Methyloceanibacter caenitepidi
  ref <308>: DATABASE ACCESSION NUMBER: NCBI ACCESSION: NZ_AP014648.1
  ref <309>: DATABASE ENTRY DATE: 2019-04-01
  ref <313>: RELEVANT RESIDUES IN SEQ ID NO: (1)..(1498)
tcaatctaagagtttgatcctggctcagaacgaacgctggcggcaggcctaacacatgcaagtcgaacgagaagctaccttcgggtagtggaaagtggcagacgggtgagtaacgcgtgggaacgtgcctttcggttcggaataactcagggaaacttgggctaataccggatacgcccttcgggggaaagatttatcgccgaaagatcggcccgcgtcagattagctagttggtggggtaatggctcaccaaggcgacgatctgtagctggtctgagaggatgatcagccacactgggactgagacacggcccagactcctacgggaggcagcagtggggaatattggacaatgggcgaaagcctgatccagccatgccgcgtgggtgaagaaggccctagggttgtaaacccctttcagcggggaagataatgacggtacccgcagaagaagccccggctaactccgtgccagcagccgcggtaatacggagggggctagcgttgttcggaattactgggcgtaaagcgcgcgtaggcggactttcaagtcaggggtgaaatcccgaggctcaacctcggaactgcctttgatactgtaagtcttgagtccgagagaggtgagtggaattcctagtgtagaggtgaaattcgtagatattaggaagaacaccagtggcgaaggcggctcactggctcggtactgacgctgaggcgcgaaagcgtggggagcaaacaggattagataccctggtagtccacgccgtaaactatggatgctagccgtcggggagcatgctcttcggtggcgcagccaacgcattaagcatcccgcctggggagtacggtcgcaagattaaaactcaaaggaattgacgggggcccgcacaagcggtggagcatgtggtttaattcgaggcaacgcgaagaaccttaccagctcttgacttcctggtcggggctccagagacggagctcttcaattggccagtgacaggtgctgcatggctgtcgtcagctcgtgtcgtgagatgttgggttaagtcccgcaacgagcgcaacccctaccattagttgccagcattaagttgggcactctagtgggactgccggtgataagccggaggaaggtggggatgacgtcaagtcatcatggcccttacgggctgggctacacacgtgctacaatggcagtgacaatgggcagctacttcgcgaggagatgctaatcccaaaaaactgtctcagttcggattgttctctgcaactcgagagcatgaagtcggaatcgctagtaatcgcggatcagcatgccgcggtgaatacgttcccgggccttgtacacaccgcccgtcacaccatgggagttggttttacccgaagacggtgcgctaaccagcaatggaggcagccggccacggtagggtcagcgactggggtgaagtcgtaacaaggtagccgtaggggaacctgcggctggatcacctcctttctaagg

SEQ ID NO: 5665 - DNA, 1499 bp, Methyloceanibacter marginalis
  ref <308>: DATABASE ACCESSION NUMBER: NCBI ACCESSION: NZ_LPWD01000072.1
  ref <309>: DATABASE ENTRY DATE: 2019-04-01
  ref <313>: RELEVANT RESIDUES IN SEQ ID NO: (1)..(1499)
tcaacttgagagtttgatcctggctcagaacgaacgctggcggcaggcctaacacatgcaagtcgaacgagaagccacctcgggtggtggacagtggcagacgggtgagtaacgcgtgggaacgtgcctttcggttcgggataacccagggaaacttgggctaataccggatacgcccttcgggggaaagattcattgccgaaagatcggcccgcgtcggattagcttgttggtggggtaaaagcctaccaaggcgacgatccgtagctggtctgagaggatgaccagccacactgggactgagacacggcccagactcctacgggaggcagcagtggggaatattggacaatgggcgaaagcctgatccagccatgccgcgtgggtgaagaaggccttagggttgtaaacccctttcagcggggaagataatgacggtacccgcagaagaagccccggctaactccgtgccagcagccgcggtaatacggagggggctagcgttgttcggaattactgggcgtaaagcgcgcgtaggcggatctgcaagtcaggggtgaaatcccgaggctcaacctcggaactgcctttgatactgcggatctcgagtccgagagaggtgagtggaattcctagtgtagaggtgaaattcgtagatattaggaagaacaccagtggcgaaggcggctcactggctcggtactgacgctgaggcgcgaaagcgtggggagcaaacaggattagataccctggtagtccacgccgtaaactatgggtgctagccgtcggagagcatgctcttcggtggcgcagcaaacgcattaagcaccccgcctggggagtacggtcgcaagattaaaactcaaaggaattgacgggggcccgcacaagcggtggagcatgtggtttaattcgaggcaacgcgaagaaccttaccagctcttgacatcctggtcggggctccagagacggagcctatcaattggccagtgacaggtgctgcatggctgtcgtcagctcgtgtcgtgagatgttgggttaagtcccgcaacgagcgcaacccctgccattagttgccagcattaagttgggcactctagtgggactgccggtgataagccggaggaaggtggggatgacgtcaagtcatcatggcccttacgggctgggctacacacgtgctacaatggcagtgacaatgggcagccactccgcgagggggagctaatcccaaaaaactgtctcagttcggattgttctctgcaactcgagagcatgaagtcggaatcgctagtaatcgcggatcagcatgccgcggtgaatacgttcccgggccttgtacacaccgcccgtcacaccatgggagttggttttacccgaagacggtgcgctaacctcgcaagaggaggcagccggccacggtagggtcagcgactggggtgaagtcgtaacaaggtagccgtaggggaacctgcggctggatcacctcctttctaagg

SEQ ID NO: 5666 - DNA, 1500 bp, Methyloceanibacter methanicus
  ref <308>: DATABASE ACCESSION NUMBER: NCBI ACCESSION: NZ_LPWG01000011.1
  ref <309>: DATABASE ENTRY DATE: 2019-04-01
  ref <313>: RELEVANT RESIDUES IN SEQ ID NO: (1)..(1500)
tcaatctaagagtttgatcctggctcagaacgaacgctggcggcaggcctaacacatgcaagtcgaacgagaagctttccttcgggaaggtggacagtggcagacgggtgagtaacgcgtgggaacgtgcctttcggttcggaataactcagggaaacttgggctaataccggatacgcccttcgggggaaagatttatcgccgaaagatcggcccgcgtcagattagctagttggtggggtaatggctcaccaaggcgacgatctgtagctggtctgagaggatgatcagccacactgggactgagacacggcccagactcctacgggaggcagcagtggggaatattggacaatgggcgaaagcctgatccagccatgccgcgtgggtgaagaaggccctagggttgtaaacccctttcagcggggaagataatgacggtacccgcagaagaagccccggctaactccgtgccagcagccgcggtaatacggagggggctagcgttgttcggaattactgggcgtaaagcgcgcgtaggcggactttcaagtcaggggtgaaatcccgaggctcaacctcggaactgcctttgatactgtaagtcttgagtccgagagaggtgagtggaattcctagtgtagaggtgaaattcgtagatattaggaagaacaccagtggcgaaggcggctcactggctcggtactgacgctgaggtgcgaaagcgtggggagcaaacaggattagataccctggtagtccacgccgtaaactatggatgctagccgtcggggagcatgctcttcggtggcgcagcaaacgcattaagcatcccgcctggggagtacggtcgcaagattaaaactcaaaggaattgacgggggcccgcacaagcggtggagcatgtggtttaattcgaggcaacgcgaagaaccttaccagctcttgacttcctggtcggggctccagagacggagctcttcaattggccagtgacaggtgctgcatggctgtcgtcagctcgtgtcgtgagatgttgggttaagtcccgcaacgagcgcaacccctgccattagttgccagcattaagttgggcactctagtgggactgccggtgataagccggaggaaggtggggatgacgtcaagtcatcatggcccttacgggctgggctacacacgtgctacaatggcagtgacaatgggcagctactccgcgaggagatgctaatcccaaaaaactgtctcagttcggattgttctctgcaactcgagagcatgaagtcggaatcgctagtaatcgcggatcagcatgccgcggtgaatacgttcccgggccttgtacacaccgcccgtcacaccatgggagttggttttacccgaagacggtgcgctaacccgcaagggaggcagccggccacggtagggtcagcgactggggtgaagtcgtaacaaggtagccgtaggggaacctgcggctggatcacctcctttctaagg

SEQ ID NO: 5667 - DNA, 1500 bp, Methyloceanibacter sp. wino2
  ref <308>: DATABASE ACCESSION NUMBER: NCBI ACCESSION: NZ_CP028960.1
  ref <309>: DATABASE ENTRY DATE: 2019-04-01
  ref <313>: RELEVANT RESIDUES IN SEQ ID NO: (1)..(1500)
tcaatctaagagtttgatcctggctcagaacgaacgctggcggcaggcttaacacatgcaagtcgaacgagaagctttccttcgggaaggtggacagtggcagacgggtgagtaacgcgtgggaacgtgcctttcggttcggaataactcagggaaacttgggctaataccggatacgcccttcgggggaaagatttatcgccgaaagatcggcccgcgtcagattagctagttggtggggtaatggctcaccaaggcgacgatctgtagctggtctgagaggatgatcagccacactgggactgagacacggcccagactcctacgggaggcagcagtggggaatattggacaatgggcgaaagcctgatccagccatgccgcgtgggtgaagaaggccctagggttgtaaacccctttcagcggggaagataatgacggtacccgcagaagaagctccggctaactccgtgccagcagccgcggtaatacggagggagctagcgttgttcggaattactgggcgtaaagcgcgcgtaggcggactttcaagtcaggggtgaaatcccgaggctcaacctcggaactgcctttgatactgtaagtcttgagtccgagagaggtgagtggaattcctagtgtagaggtgaaattcgtagatattaggaagaacaccagtggcgaaggcggctcactggctcggtactgacgctgaggcgcgaaagcgtggggagcaaacaggattagataccctggtagtccacgccgtaaactatggatgctagccgtcggggagcatgctcttcggtggcgcagccaacgcattaagcatcccgcctggggagtacggtcgcaagattaaaactcaaaggaattgacgggggcccgcacaagcggtggagcatgtggtttaattcgaggcaacgcgaagaaccttaccagctcttgacttcctggtcggggctccagagacggagctcttcaattggccagtgacaggtgctgcatggctgtcgtcagctcgtgtcgtgagatgttgggttaagtcccgcaacgagcgcaacccctgccattagttgccagcattaagttgggcactctagtgggactgccggtgataagccggaggaaggtggggatgacgtcaagtcatcatggcccttacgggctgggctacacacgtgctacaatggcagtgacaatgggcagctactccgcgaggagatgctaatcccaaaaaactgtctcagttcggattgttctctgcaactcgagagcatgaagtcggaatcgctagtaatcgcggatcagcatgccgcggtgaatacgttcccgggccttgtacacaccgcccgtcacaccatgggagttggctttacccgaagacggtgcgctaaccagcaatggaggcagccggccacggtagggtcagcgactggggtgaagtcgtaacaaggtagccgtaggggaacctgcggctggatcacctcctttctaagg

SEQ ID NO: 5668 - DNA, 1499 bp, Methyloceanibacter superfactus
  ref <308>: DATABASE ACCESSION NUMBER: NCBI ACCESSION: NZ_LPWF01000023.1
  ref <309>: DATABASE ENTRY DATE: 2019-04-01
  ref <313>: RELEVANT RESIDUES IN SEQ ID NO: (1)..(1499)
tcaatctaagagtttgatcctggctcagaacgaacgctggcggcaggcctaacacatgcaagtcgaacgtgaagccaccttcgggtggtggaaagtggcagacgggtgagtaacgcgtgggaacgtgcctttcggttcggaataacccagggaaacttgggctaataccggatacgcccttcgggggaaagattcatcgccgaaagatcggcccgcgtcggattagcttgttggtggggtaaaagcctaccaaggcgacgatccgtagctggtctgagaggatgaccagccacactgggactgagacacggcccagactcctacgggaggcagcagtggggaatattggacaatgggcgaaagcctgatccagccatgccgcgtgggtgaagaaggccctagggttgtaaacccctttcagcggggaagataatgacggtacccgcagaagaagccccggctaactccgtgccagcagccgcggtaatacggagggggctagcgttgttcggaattactgggcgtaaagcgcgcgtaggcggactttcaagtcaggggtgaaatcccgaggctcaacctcggaactgcctttgatactgtaagtcttgagtccgagagaggtgagtggaattcctagtgtagaggtgaaattcgtagatattaggaagaacaccagtggcgaaggcggctcactggctcggtactgacgctgaggcgcgaaagcgtggggagcaaacaggattagataccctggtagtccacgccgtaaactatgggtgctagccgtcggagagcatgctcttcggtggcgcagcaaacgcattaagcaccccgcctggggagtacggtcgcaagattaaaactcaaaggaattgacgggggcccgcacaagcggtggagcatgtggtttaattcgaggcaacgcgaagaaccttaccagctcttgacttcctggtcggggctccagagacggagctcttcaattggccagtgacaggtgctgcatggctgtcgtcagctcgtgtcgtgagatgttgggttaagtcccgcaacgagcgcaacccctgccattagttgccagcattaagttgggcactctagtgggactgccggtgataagccggaggaaggtggggatgacgtcaagtcatcatggcccttacgggctgggctacacacgtgctacaatggcagtgacaatgggcagccactccgcgaggaggagctaatcccaaaaaactgtctcagttcggattgttctctgcaactcgagagcatgaagtcggaatcgctagtaatcgcggatcagcatgccgcggtgaatacgttcccgggcctgtacacaccgcccgtcacaccatgggagttggctttacccgaagacggtgcgctaacctcgcaagaggaggcagccggccacggtagggtcagcgactggggtgaagtcgtaacaaggtagccgtaggggaacctgcggctggatcacctcctttctaagg

SEQ ID NO: 5669 - DNA, 1492 bp, Methylocella silvestris
  ref <308>: DATABASE ACCESSION NUMBER: NCBI ACCESSION: NZ_PDZR01000046.1
  ref <309>: DATABASE ENTRY DATE: 2019-04-01
  ref <313>: RELEVANT RESIDUES IN SEQ ID NO: (1)..(1492)
caacttgagagtttgatcctggctcagaacgaacgctggcggcaggcctaacacatgcaagtcgaacgccctggcaacagggagtggcagacgggtgagtaacacgtgggaacatacccttcggttcggaacaactcagggaaacttgagctaataccggatacgccctttgggggaaagatttatcgccgaaggattggcccgcgtctgattagctagttggcggggtaacggcccaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttacctgggaagataatgacggtaccaggagaataagccccggctaacttcgtgccagcagccgcggtaatacgaagggggctagcgttgttcggatttactgggcgtaaagcgcacgtaggcggatctttaagtcaggggtgaaatcccggggctcaacctcggaactgcctttgatactggggatctcgagtccgggagaggtgagcggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttaggcagcttgctgcttagtggcgcagttaacgctttaagcatcccgcctggggagtacggtcgcaagattaaaactcaaaggaattgacgggggcccgcacaagcggtggagcatgtggtttaattcgaagcaacgcgcagaaccttaccagctcttgacatgtccggtttggtttccagagatggattccttcagttaggctggccggaacacaggtgctgcatggctgtcgtcagctcgtgtcgtgagatgttgggttaagtcccgcaacgagcgcaaccctcgcccttagttgccatcatttagttgggcactctagggggactgccggtgataagccgagaggaaggtggggatgacgtcaagtcctcatggcccttacgggctgggctacacacgtgctacaatggcggtgacagtgggatgctaaggggcgacccctcgcaaatctcaaaaagccgtctcagttcggattgcgctctgcaactcgagcgcatgaaggtggaatcgctagtaatcgtagatcagaacgctacggtgaatacgttcccgggccttgtacacaccgcccgtcacaccatgggagttggttctacccgaaggcgttttcttaaccgcaaggagagaggcgaccacggtagggtcagcgactggggtgaagtcgtaacaaggtagccgtaggggaacctgcggctggatcacctcctttctaag

SEQ ID NO: 5670 - DNA, 1543 bp, Methylococcaceae bacterium FWC3
  ref <308>: DATABASE ACCESSION NUMBER: NCBI ACCESSION: NZ_SEYW01000002.1
  ref <309>: DATABASE ENTRY DATE: 2019-04-01
  ref <313>: RELEVANT RESIDUES IN SEQ ID NO: (1)..(1543)
taaactgaagagtttgatcatggctcagattgaacgctggcggcatgcttaacacatgcaagtcgaacggcagcacgggcttcggcctggtggcgagtggcggacgggtgagtaatgcttgggaatctgcctagtggtgggggataacgctccgaaaggagcgctaataccgcatacgttctacggaagaaagcgggggatcttcggacctcgcgccattagatgagcccaagtccgattagcttgttggtagggtaaaggcctaccaaggcgacgatcggtagctggtctgagaggacgatcagccacactgggactgagacacggcccagactcctacgggaggcagcagtggggaatattggacaatgggcgcaagcctgatccagcaatgccgcgtgtgtgaagaaggcctgcgggttgtaaagcactttaagcaggaaagaaggggtgggagttaatacctttcatcattgacgttacctgcagaataagcaccggctaactccgtgccagcagccgcggtaatacggagggtgcgagcgttaatcggaattactgggcgtaaagcgcgcgtaggcggtttgatgagtccgtcgtgaaagccctgggcttaacctgggaactgcggtggatactgtcgggctagagtgtggtagaggggagtggaatttccggtgtagcagtgaaatgcgtagagatcggaaggaacaccagtggcgaaggcggctccctggaccaacactgacgctgaggtgcgaaagcgtggggagcaaacaggattagataccctggtagtccacgctgtaaacgatgagaactagccgttgggcacgatttgagtgtttagtggcgcagctaacgcgataagttctccgcctggggagtacggccgcaaggttaaaactcaaatgaattgacgggggcccgcacaagcggtggagcatgtggtttaattcgatgcaacgcgaagaaccttacctggccttgacatgtcgcgaaccctgcagagatgtgggggtgccttcgggagcgcgaacacaggtgctgcatggctgtcgtcagctcgtgtcgtgagatgttgggttaagtcccgtaacgagcgcaacccttgtccctagttgccagcgagtgaagtcgggaactctagggagaccgccggtgataaaccggaggaaggtggggatgacgtcaagtcatcatggcccttatggccagggctacacacgtgctacaatggtcggtacagagggttgccaacccgcgagggggagctaatcccgcaaagccgatcgtagtccggattgcagtctgcaactcgactgcatgaagtcggaatcgctagtaatcgcggatcagcatgccgcggtgaatacgttcccgggccttgtacacaccgcccgtcacaccatgggagtgggttgcaccagaagccggtagtctaaccttcgggagggcgccgaccacggtgtgattcatgactggggtgaagtcgtaacaaggtagccgtaggggaacctgcggctggatcacctcctttaaa

SEQ ID NO: 5671 - DNA, 1489 bp, Methylocystis bryophila
  ref <308>: DATABASE ACCESSION NUMBER: NCBI ACCESSION: NZ_CP019948.1
  ref <309>: DATABASE ENTRY DATE: 2019-04-01
  ref <313>: RELEVANT RESIDUES IN SEQ ID NO: (1)..(1489)
caacttgagagtttgatcctggctcagaacgaacgctggcggcaggcttaacacatgcaagtcgaacgctgtagcaatacagagtggcagacgggtgagtaacgcgtgggaacgtgcccttcggttcggaataactcagggaaacttgagctaataccggatacgtgcgagagcagaaagatttatcgccgaaggatcggcccgcgtccgattagctagttggtggggtaatggcccaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggatttactgggcgtaaagcgcacgtaggcggatctttaagtcaggggtgaaatcccggggctcaacctcggaactgcctttgatactggaggtctcgagtccgggagaggtgagtggaactgcgagtgtagaggtgaaattcgtagatattcgcaagaacaccagtggcgaaggcggctcactggcccggaactgacgctgaggtgcgaaagcgtggggagcaaacaggattagataccctggtagtccacgccgtaaacgatggatgctagccgttggggagcttgctcttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcccggtatggtcgacagagatgtcttccttcccgcaaggggccggagcacaggtgctgcatggctgtcgtcagctcgtgtcgtgagatgttgggttaagtcccgcaacgagcgcaaccctcgcccttagttgccatcattcagttgggcactctagggggactgccggtgataagccgcgaggaaggtggggatgacgtcaagtcctcatggcccttacaggctgggctacacacgtgctacaatggcggtgacagagggatgcgaaggggcgacctggagcaaatcctttaaaagccgtctcagttcggattgcactctgcaactcgggtgcatgaaggtggaatcgctagtaatcgcagatcagcacgctgcggtgaatacgttcccgggccttgtacacaccgcccgtcacaccatgggagttggttttacccgaaggcgtttcgctaaccgcaaggaggcagacgaccacggtagggtcagcgactggggtgaagtcgtaacaaggtagccgtaggggaacctgcggctggatcacctcctttct

SEQ ID NO: 5672 - DNA, 1493 bp, Methylocystis hirsuta
  ref <308>: DATABASE ACCESSION NUMBER: NCBI ACCESSION: NZ_QWDD01000001.1
  ref <309>: DATABASE ENTRY DATE: 2019-04-01
  ref <313>: RELEVANT RESIDUES IN SEQ ID NO: (1)..(1493)
tcaaacttgagagtttgatcctggctcagaacgaacgctggcggcaggcctaacacatgcaagtcgaacgccctagcaatagggagtggcagacgggtgagtaacgcgtgggaacgtacccttcggtctggaataacccagggaaacttggactaataccggatacgtgcgagagcagaaagatttatcgccgaaggatcggcccgcgtccgattagctagttggtgaggtaaaagctcaccaaggcgacgatcggtagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggaatcactgggcgtaaagcgcacgtaggcggatctttaagtcaggggtgaaatcccgaggctcaacctcggaactgcctttgatactggaggtctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaactatggatgctagccgttgggcagcttgctgttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcccggtatgatcgccagagatggctttcttcccgcaaggggccggtgcacaggtgctgcatggctgtcgtcagctcgtgtcgtgagatgttgggttaagtcccgcaacgagcgcaaccctcgcccttagttgccatcattaagttgggcactctagggggactgccggtgataagccgcgaggaaggtggggatgacgtcaagtcctcatggcccttacaggctgggctacacacgtgctacaatggcggtgacaatgggatgcggaagggcgacctcgagcaaatctcaaaaagccgtctcagttcggattgcactctgcaactcgagtgcatgaaggtggaatcgctagtaatcgcagatcagcacgctgcggtgaatacgttcccgggccttgtacacaccgcccgtcacaccatgggagttggttttacccgaaggcgtttcgccaaccgcaaggaggcaggcgaccacggtagggtcagcgactggggtgaagtcgtaacaaggtagccgtaggggaacctgcggctggatcacctcctttctaag

SEQ ID NO: 5673 - DNA, 1494 bp, Methylocystis parvus
  ref <308>: DATABASE ACCESSION NUMBER: NCBI ACCESSION: NZ_AJTV01000076.1
  ref <309>: DATABASE ENTRY DATE: 2019-04-01
  ref <313>: RELEVANT RESIDUES IN SEQ ID NO: (1)..(1494)
tccaacttgagagtttgatcctggctcagaacgaacgctggcggcaggcctaacacatgcaagtcgaacgctgtagcaatacagagtggcagacgggtgagtaacgcgtgggaacgtgcctttcggttcggaataactcagggaaacttgagctaataccggatacgccctttgggggaaagatttattgccgaaagatcggcccgcgtccgattagctagttggtgtggtaatggcgcaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggaatcactgggcgtaaagcgcacgtaggcggatctttaagtcaggggtgaaatcccgaggctcaacctcggaactgcctttgatactggaggtctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttggggagcatgctcttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcccggtatgatcgccagagatggctttcttcccgcaaggggccggagcacaggtgctgcatggctgtcgtcagctcgtgtcgtgagatgttgggttaagtcccgcaacgagcgcaaccctcgcccttagttgccatcattcagttgggcactctagggggactgccggtgataagccgcgaggaaggtggggatgacgtcaagtcctcatggcccttacaggctgggctacacacgtgctacaatggcggtgacaatgggaagcgaaagggcgacctggagcaaatctcaaaaagccgtctcagttcggattgcactctgcaactcgagtgcatgaaggtggaatcgctagtaatcgcagatcagcacgctgcggtgaatacgttcccgggccttgtacacaccgcccgtcacaccatgggagttggttttacccgaaggcgtttcgccaaccgcaaggaggcaggcgaccacggtagggtcagcgactggggtgaagtcgtaacaaggtagccgtaggggaacctgcggctggatcacctcctttctaagg

SEQ ID NO: 5674 - DNA, 1493 bp, Methylocystis rosea
  ref <308>: DATABASE ACCESSION NUMBER: NCBI ACCESSION: NZ_CP034086.1
  ref <309>: DATABASE ENTRY DATE: 2019-04-01
  ref <313>: RELEVANT RESIDUES IN SEQ ID NO: (1)..(1493)
tcaaacttgagagtttgatcctggctcagaacgaacgctggcggcaggcctaacacatgcaagtcgaacgccctagcaatagggagtggcagacgggtgagtaacgcgtgggaacgtacccttcggtctggaataacccagggaaacttgggctaataccggatacgtgcgagagcagaaagatttatcgccgaaggatcggcccgcgtccgattagctagttggtgaggtaaaagctcaccaaggcgacgatcggtagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggatttactgggcgtaaagcgcacgtaggcggatttttaagtcaggggtgaaatcccaaggctcaaccttggaactgcctttgatactggaagtctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaactatggatgctagccgttgggcagcttgctgttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcccggtatgatcgccagagatggctttcttcccgcaaggggccggtgcacaggtgctgcatggctgtcgtcagctcgtgtcgtgagatgttgggttaagtcccgcaacgagcgcaaccctcgcccttagttgccatcattaagttgggcactctagggggactgccggtgataagccgcgaggaaggtggggatgacgtcaagtcctcatggcccttacaggctgggctacacacgtgctacaatggcggtgacaatgggatgcggaagggcgacctcgagcaaatctcaaaaagccgtctcagttcggattgcactctgcaactcgagtgcatgaaggtggaatcgctagtaatcgcagatcagcacgctgcggtgaatacgttcccgggccttgtacacaccgcccgtcacaccatgggagttggttttacccgaaggcgtttcgccaaccgcaaggaggcaggcgaccacggtagggtcagcgactggggtgaagtcgtaacaaggtagccgtaggggaacctgcggctggatcacctcctttctaag

SEQ ID NO: 5675 - DNA, 1494 bp, Methylocystis sp. ATCC 49242
  ref <308>: DATABASE ACCESSION NUMBER: NCBI ACCESSION: NZ_KE124774.1
  ref <309>: DATABASE ENTRY DATE: 2019-04-01
  ref <313>: RELEVANT RESIDUES IN SEQ ID NO: (1)..(1494)
tccaacttgagagtttgatcctggctcagaacgaacgctggcggcaggcctaacacatgcaagtcgaacgctgtagcaatacagagtggcagacgggtgagtaacgcgtgggaacgtgcccttcggttcggaataactcagggaaacttgagctaataccggatacgtgcgagagcagaaagatttatcgccgaaggatcggcccgcgtccgattagctagttggtgaggtaacggctcaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggaatcactgggcgtaaagcgcacgtaggcggatctttaagtcaggggtgaaatcccgaggctcaacctcggaactgcctttgatactggaggtctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttggggagcttgctcttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcccggtatgatcgccagagatggctttcttcccgcaaggggccggtgcacaggtgctgcatggctgtcgtcagctcgtgtcgtgagatgttgggttaagtcccgcaacgagcgcaaccctcgcccttagttgccatcattcagttgggcactctagggggactgccggtgataagccgcgaggaaggtggggatgacgtcaagtcctcatggcccttacaggctgggctacacacgtgctacaatggcggtgacaatgggaagcgaaagggcgacctggagcaaatctcaaaaagccgtctcagttcggattgcactctgcaactcgagtgcatgaaggtggaatcgctagtaatcgcagatcagcacgctgcggtgaatacgttcccgggccttgtacacaccgcccgtcacaccatgggagttggttttacccgaaggcgtttcgccaaccgcaaggaggcaggcgaccacggtagggtcagcgactggggtgaagtcgtaacaaggtagccgtaggggaacctgcggctggatcacctcctttctaagg

SEQ ID NO: 5676 - DNA, 1494 bp, Methylocystis sp. LW5
  ref <308>: DATABASE ACCESSION NUMBER: NCBI ACCESSION: NZ_JMKQ01000005.1
  ref <309>: DATABASE ENTRY DATE: 2019-04-01
  ref <313>: RELEVANT RESIDUES IN SEQ ID NO: (1)..(1494)
ttcaacttgagagtttgatcctggctcagaacgaacgctggcggcaggcctaacacatgcaagtcgaacgctgtagcaatacagagtggcagacgggtgagtaacgcgtgggaacgtgcctttcggttcggaataactcagggaaacttgagctaataccggatacgcccttcgggggaaagatttattgccgaaagatcggcccgcgtccgattagctagttggtgaggtaacggcccaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggaatcactgggcgtaaagcgcacgtaggcggatctttaagtcaggggtgaaatcccgaggctcaacctcggaactgcctttgatactgggggtctagagtccgggagaggtgagtggaactgcgagtgtagaggtgaaattcgtagatattcgcaagaacaccagtggcgaaggcggctcactggcccggaactgacgctgaggtgcgaaagcgtggggagcaaacaggattagataccctggtagtccacgccgtaaacgatggatgctagccgttgggcagcttgctgttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcccggtatgatcgccagagatggctttcttcccgcaaggggccggtgcacaggtgctgcatggctgtcgtcagctcgtgtcgtgagatgttgggttaagtcccgcaacgagcgcaaccctcgcccttagttgccatcattcagttgggcactctagggggactgccggtgataagccgcgaggaaggtggggatgacgtcaagtcctcatggcccttacaggctgggctacacacgtgctacaatggcggtgacaatgggacgcgaaggggcgacccttagcaaatctcaaaaaaccgtctcagttcggattgcactctgcaactcgagtgcatgaaggtggaatcgctagtaatcgcagatcagcacgctgcggtgaatacgttcccgggccttgtacacaccgcccgtcacaccatgggagttggctttacccgaaggcgtttcgctaaccgcaaggaggcagacgaccacggtagggtcagcgactggggtgaagtcgtaacaaggtagccgtaggggaacctgcggctggatcacctcctttctaagg

SEQ ID NO: 5677 - DNA, 356 bp, Methylocystis sp. MitZ-2018
  ref <308>: DATABASE ACCESSION NUMBER: NCBI ACCESSION: NZ_PYDU01000041.1
  ref <309>: DATABASE ENTRY DATE: 2019-04-01
  ref <313>: RELEVANT RESIDUES IN SEQ ID NO: (1)..(356)
tgtgatcagtcagtatcaaatctcaaacttgagagtttgatcctggctcagaacgaacgctggcggcaggcctaacacatgcaagtcgaacgccctagcaatagggagtggcagacgggtgagtaacgcgtgggaacgtacccttcggtctggaataacccagggaaacttgggctaataccggatacgtgcgagagcagaaagatttatcgccgaaggatcggcccgcgtccgattagctagttggtgaggtaaaagctcaccaaggcgacgatcggtagctggtctgagaggatgatcagccacactgggactgagacacggcccagactcctacgggaggcagcagtggggaa

SEQ ID NO: 5678 - DNA, 601 bp, Methylocystis sp. SB2
  ref <308>: DATABASE ACCESSION NUMBER: NCBI ACCESSION: NZ_AYNA01000116.1
  ref <309>: DATABASE ENTRY DATE: 2019-04-01
  ref <313>: RELEVANT RESIDUES IN SEQ ID NO: (1)..(601)
agtggggaatattggacaatgggcgcaagcctgatccagcaataccgcgtgtgtgaagaaggcctgagggttgtaaagcacttttaatcgggaggaacatctgatggcgaatacccatcagtctgacattaccgatagaaaaagcaccggctaactccgtgccagcagccgcggtaatacggagggtgcaagcgttaatcggaattactgggcgtaaagcgtgcgtaggcggctgcttaagtcagatgtgaaagccccgggcttaacctgggaacggcatttgatactgggcagctcgagttgagtagaggagaggggaatttccggtgtagcggtgaaatgcgtagagatcggaaggaacaccagtggcgaaggcgcctctctggactcaaactgacgctgaggtacgaaagcgtgggtagcaaacaggattagataccctggtagtccacgccgtaaacgatgtcaactagccgttggtcttattcgtaagattcgtggcgcagctaacgcgataagttgaccgcctggggagtacggccgcaaggttaaaactcaaatgaattgacgggggcccgcacaagcggtggagcatgtggtt

SEQ ID NO: 5679 - DNA, 1493 bp, Methylocystis sp. SC2
  ref <308>: DATABASE ACCESSION NUMBER: NCBI ACCESSION: NC_018485.1
  ref <309>: DATABASE ENTRY DATE: 2019-04-01
  ref <313>: RELEVANT RESIDUES IN SEQ ID NO: (1)..(1493)
tcaaacttgagagtttgatcctggctcagaacgaacgctggcggcaggcctaacacatgcaagtcgaacgccctagcaatagggagtggcagacgggtgagtaacgcgtgggaacgtacccttcggtctggaataacccagggaaacttgggctaataccggatacgtgcgagagcagaaagatttatcgccgaaggatcggcccgcgtccgattagctagttggtgaggtaaaagctcaccaaggcgacgatcggtagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggaatcactgggcgtaaagcgcacgtaggcggatctttaagtcaggggtgaaatcccgaggctcaacctcggaactgcctttgatactggaggtctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaactatggatgctagccgttgggcagcttgctgttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcccggtatgatcgccagagatggctttcttcccgcaaggggccggtgcacaggtgctgcatggctgtcgtcagctcgtgtcgtgagatgttgggttaagtcccgcaacgagcgcaaccctcgcccttagttgccatcattcagttgggcactctagggggactgccggtgataagccgcgaggaaggtggggatgacgtcaagtcctcatggcccttacaggctgggctacacacgtgctacaatggcggtgacaatgggatgcggaagggcgacctcgagcaaatctcaaaaagccgtctcagttcggattgcactctgcaactcgagtgcatgaaggtggaatcgctagtaatcgcagatcagcacgctgcggtgaatacgttcccgggccttgtacacaccgcccgtcacaccatgggagttggttttacccgaaggcgtttcgccaaccgcaaggaggcaggcgaccacggtagggtcagcgactggggtgaagtcgtaacaaggtagccgtaggggaacctgcggctggatcacctcctttctaag

SEQ ID NO: 5680 - DNA, 1499 bp, Methyloferula stellata
  ref <308>: DATABASE ACCESSION NUMBER: NCBI ACCESSION: NZ_ARWA01000001.1
  ref <309>: DATABASE ENTRY DATE: 2019-04-01
  ref <313>: RELEVANT RESIDUES IN SEQ ID NO: (1)..(1499)
tcattcaacttgagagtttgatcctggctcagaacgaacgctggcggcaggcctaacacatgcaagtcgaacgctgtagcaatacagagtggcagacgggtgagtaacacgtgggaacatgcccttcggttcggaataactcagggaaacttgagctaataccggatacgtccgcgaggagaaagatttatcgccgaaggattggcccgcgtctgattagcttgttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccttagggttgtaaagctcttttgcccgggaagataatgacggtaccgggagaataagccccggctaacttcgtgccagcagccgcggtaatacgaagggggctagcgttgttcggatttactgggcgtaaagcgcacgtaggcggattcttaagtcagaggtgaaatcccagggctcaaccctggaactgcctttgatactggggatcttgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttaggcagcttgctgcttagtggcgcagttaacgctttaagcatcccgcctggggagtacggtcgcaagattaaaactcaaaggaattgacgggggcccgcacaagcggtggagcatgtggtttaattcgaagcaacgcgcagaaccttaccagctcttgacatgtcccgtgtggtttccagagatggattccttcagttcggctggcgggaacacaggtgctgcatggctgtcgtcagctcgtgtcgtgagatgttgggttaagtcccgcaacgagcgcaaccctcgcccttagttgccatcatttagttgggcactctagggggactgccggtgataagccgagaggaaggtggggatgacgtcaagtcctcatggcccttacgggctgggctacacacgtgctacaatggcggtgacagtgggatgcaaaagggcgacctctagcaaatctcaaaaagccgtctcagttcggattgcactctgcaactcgagtgcatgaaggtggaatcgctagtaatcgtagatcagaacgctacggtgaatacgttcccgggccttgtacacaccgcccgtcacaccatgggagttggttctacccgaaggcgttttgctaaccgcaagggggcagacgaccacggtagggtcagcgactggggtgaagtcgtaacaaggtagccgtaggggaacctgcggctggatcacctcctttctaagga

SEQ ID NO: 5681 - DNA, 1483 bp, Methyloligella halotolerans
  ref <308>: DATABASE ACCESSION NUMBER: NCBI ACCESSION: NZ_MASI01000003.1
  ref <309>: DATABASE ENTRY DATE: 2019-04-01
  ref <313>: RELEVANT RESIDUES IN SEQ ID NO: (1)..(1483)
tcaatctgagagtttgatcctggctcagaacgaacgctggcggcaggcttaacacatgcaagtcgaacgcaccttcgggtgagtggcagacgggtgagtaacgcgtgggaacgtgcctttcggtctggaataacccagggaaacttgggctaataccggatacgccctccgggggaaagatttatcgccgaaagatcggcccgcgtcggattagcttgttggtggggtaatggcctaccaaggctacgatccgtagctggtctgagaggatgatcagccacactgggactgagacacggcccagactcctacgggaggcagcagtggggaatattggacaatgggcgcaagcctgatccagccatgccgcgtgagtgacgaaggccttagggttgtaaagctctttcagcggggaagataatgacggtacccgcagaagaagccccggctaactccgtgccagcagccgcggtaatacggagggggctagcgttgttcggaattactgggcgtaaagcgcgcgtaggcggactttcaagtcaggggtgaaatcccggggcttaacctcggaactgcctttgatactgttggtcttgagtccgggagaggtgagcggaattcctagtgtagaggtgaaattcgtagatattaggaagaacaccagtggcgaaggcggctcactggcccggtactgacgctgaggcgcgaaagcgtggggagcaaacaggattagataccctggtagtccacgccgtaaacgatggatgctagccgtcggtcagcatgctgatcggtggcgcagctaacgcattaagcatcccgcctggggagtacggtcgcaagattaaaactcaaaggaattgacgggggcccgcacaagcggtggagcatgtggtttaattcgaggcaacgcgaagaaccttaccagcccttgacatcccggtttggggaccagagatggaccccatttaacgccggtgacaggtgctgcatggctgtcgtcagctcgtgtcgtgagatgttgggttaagtcccgcaacgagcgcaacccctaccattagttgccagcattaagttgggcactctagtgggactgccggtgataagccggaggaaggtggggatgaggtcaagtcatcatggcccttacgggctgggctacacacgtgctacaatggcggtgacagagggcagccactccgcgaggaggagctaatccctaaaaaccgtctcagttcggattgttctctgcaactcgagagcatgaagtcggaatcgctagtaatcgcggatcagcatgccgcggtgaatacgttcccgggccttgtacacaccgcccgtcacaccatgggagttggctttacccgaagacggtgcgctaacctcgcaagaggaggcagccggccacggtagggtcagcgactggggtgaagtcgtaacaaggtagccgtaggggaacctgcggctggatcacctcctttct

SEQ ID NO: 5682 - DNA, 1532 bp, Methylomagnum ishizawai
  ref <308>: DATABASE ACCESSION NUMBER: NCBI ACCESSION: NZ_FXAM01000004.1
  ref <309>: DATABASE ENTRY DATE: 2019-04-01
  ref <313>: RELEVANT RESIDUES IN SEQ ID NO: (1)..(1532)
taaactgaagagtttgatcatggctcagattgaacgctggcggcatgcttaacacatgcaagtcgaacggtagggacttcggtcctgagagtggcggacgggtgagtaacacgtaggaatctgcctgatagtgggggataacccggggaaactcgggctaataccgcatacgctccacggaggaaagcgggggatcttcggacctcgcgctatcagatgagcctgcgtccgattagctagttggcggggtaagagcccaccaaggcgacgatcggtagctggtctgagaggacgatcagccacactggaactgagacacggtccagactcctacgggaggcagcagtggggaatattggacaatgggcgcaagcctgatccagcaatgccgcgtgtgtgaagaaggcctgcgggttgtaaagcactttaagcaggaaagaaggctccaaggccaatacccttggagattgacgttacctgcagaataagcaccggctaactccgtgccagcagccgcggtaatacggagggtgcgagcgttaatcggaattactgggcgtaaagcgcgcgtaggcggtccgttaagtcagccgtgaaagccccgggcttaacctgggaactgcggatgatactggcggactagagtgtggcagagggtggcggaatttccggtgtagcagtgaaatgcgtagagatcggaaggaacaccagtggcgaaggcggccatctgggccaacactgacgctgaggtgcgaaagcgtggggagcaaacaggattagataccctggtagtccacgccgtaaacgatgagaactagccgttgggcacgatttggtgcttagtggcgcagctaacgcgataagttctccgcctggggagtacggccgcaaggttaaaactcaaatgaattgacgggggcccgcacaagcggtggagcatgtggtttaattcgatgcaacgcgaagaaccttacctggccttgacatccagagaactttccagagatggatcggtgccttcgggaactctgagacaggtgctgcatggctgtcgtcagctcgtgtcgtgagatgttgggttaagtcccgtaacgagcgcaacccttgtccctagttgccagcgtaaagtcgggaactctagggagaccgccggtgataaaccggaggaaggtggggatgacgtcaagtcatcatggcccttatggccagggctacacacgtgctacaatggccggtacagagggttgcgaagccgcgaggtgaagccaatcccacaaagccggtcgtagtccggattggagtctgcaactcgactccatgaagtcggaatcgctagtaatcgcggatcagaatgccgcggtgaatacgttcccgggccttgtacacaccgcccgtcacaccatgggagtgggttgcaccagaagcaggtagtctaaccgcaaggagggcgcttgccacggtgtgattcatgactggggtgaagtcgtaacaaggtagccgtaggggaacctgcggctggatcacctcctttc

SEQ ID NO: 5683 - DNA, 1535 bp, Methylomicrobium sp. wino1
  ref <308>: DATABASE ACCESSION NUMBER: NCBI ACCESSION: NZ_CP024202.1
  ref <309>: DATABASE ENTRY DATE: 2019-04-01
  ref <313>: RELEVANT RESIDUES IN SEQ ID NO: (1)..(1535)
gaactgaagagtttgatcatggctcagattgaacgctggcggtatgcttaacacatgcaagtcgaacggtaacggaccttcgggtgccgacgagtggcggacgggtgagtaacgcgtaggaatctgcctggtagtgggggacaactcggagaaattcgagctaataccgcatacgccctacgggggaaagcgggggctcttcggacctcgcgctatcggatgagcctgcgttggattagctagttggtggggtaaaggcctaccaaggcgacgatccatagctggtctgagaggacgatcagccacactgggactgagacacggcccagactcctacgggaggcagcagtggggaatattggacaatgggggcaaccctgatccagcaataccgcgtgtgtgaagaaggcctgagggttgtaaagcactttcaatagggaggaaaaagcgttggttaatagctgatgccttgacattacctatagaagaagcaccggctaactccgtgccagcagccgcggtaatacggagggtgcgagcgttaatcggaattactgggcgtaaagcgtgcgtaggcggttatttaagtcagatgtgaaagccccgggcttaacctgggaacggcatttgatactgggtaacttgagtttaggagaggagagtggaatttccggtgtagcggtgaaatgcgtagagatcggaaggaacaccagtggcgaaggcggctctctggcctaaaactgacgctgaggtacgaaagcgtgggtagcaaacaggattagataccctggtagtccacgccgtaaacgatgtcaactagccgttgggtctttattgagacttagtggtgcagctaacgcattaagttgaccgcctggggagtacggccgcaaggttaaaactcaaatgaattgacgggggcccgcacaagcggtggagcatgtggtttaattcgatgcaacgcgaagaaccttacctacccttgacatccagagaatctgtgagagatcgtggagtgccttcgggaactctgagacaggtgctgcatggctgtcgtcagctcgtgtcgtgagatgttgggttaagtcccgtaacgagcgcaacccttatccttagttgccaacaggtcaagctgggaactctagggagactgccggtgataaaccggaggaaggtggggacgacgtcaagtcatcatggcccttatgggtagggctacacacgtgctacaatggccggtacagagggcagcgaacttgcgaaagtcagcaaatcccagaaagccggtcctagtccggattgcagtctgcaactcgactgcatgaagtcggaatcgctagtaatcgcgaatcagaatgtcgcggtgaatacgttcccgggccttgtacacaccgcccgtcacaccatgggagtgggttgcaaaagaagtaggtagtttaaccttcgggagggcgcttaccactttgtgattcatgactggggtgaagtcgtaacaaggtagccctaggggaacctggggctggatcacctcctta

SEQ ID NO: 5684 - DNA, 1546 bp, Methylomonas clara
  ref <308>: DATABASE ACCESSION NUMBER: NCBI ACCESSION: NZ_CP033953.1
  ref <309>: DATABASE ENTRY DATE: 2019-04-01
  ref <313>: RELEVANT RESIDUES IN SEQ ID NO: (1)..(1546)
attaaactgaagagtttgatcctggctcagattgaacgctggcggaatgctttacacatgcaagtcgaacgatgaaccttagcttgctaaggggattagtggcgaacgggtgagtaatatatcggaacgtgccttgtaatgggggataactagtcgaaagattagctaataccgcatacgccctgagggggaaagtaggggatcttcggaccttacgttataagagcggccgatatctgattagctagttggtggggtaatggcctaccaaggcatcgatcagtagctggtctgagaggacgaccagccacactggaactgagacacggtccagactcctacgggaggcagcagtggggaattttggacaatgggcgcaagcctgatccagccattccgcgtgagtgaagaaggccttcgggttgtaaagctctttcgcaagggaagaaaacttacattctaataaagtgtgaggctgacggtaccttgataagaagcaccggctaactacgtgccagcagccgcggtaatacgtagggtgcgagcgttaatcggaattactgggcgtaaagcgtgcgcaggcggtttggcaagtcagatgtgaaatccccgagctcaacttgggaactgcgtttgaaactgccagactagaatatgtcagaggggggtagaattccacgtgtagcagtgaaatgcgtagagatgtggaggaataccaatggcgaaggcagccccctgggataatattgacgctcatgcacgaaagcgtggggagcaaacaggattagataccctggtagtccacgccctaaacgatgtctactagttgttggtggagtaaaatccatgagtaacgcagctaacgcgtgaagtagaccgcctggggagtacggtcgcaagattaaaactcaaaggaattgacgggggcccgcacaagcggtggattatgtggattaattcgatgcaacgcgaaaaaccttacctggccttgacatgccactaacgaagcagagatgcattaggtgcccgtaagggaaagtggacacaggtgctgcatggctgtcgtcagctcgtgtcgtgagatgttgggttaagtcccgcaacgagcgcaacccttgccattaattgccatcatttagttgggcactttaatgggactgccggtgacaaaccggaggaaggtggggatgacgtcaagtcctcatggcccttatggccagggcttcacacgtaatacaatggtcggtacagagagttgccaacccgcgagggggagctaatctcagaaagccgatcgtagtccggattgttctctgcaactcgagagcatgaagtcggaatcgctagtaatcgcggatcagcatgtcgcggtgaatacgttcccgggccttgtacacaccgcccgtcacaccatgggagtgggttttaccagaagtagttagtctaaccgcaagggggacgattaccacggtagtattcatgactggggtgaagtcgtaacaaggtagccgtatcggaaggtgcggctggatcacctcctttctag

SEQ ID NO: 5685 - DNA, 1535 bp, Methylomonas sp. Kb3
  ref <308>: DATABASE ACCESSION NUMBER: NCBI ACCESSION: NZ_PIZT01000002.1
  ref <309>: DATABASE ENTRY DATE: 2019-04-01
  ref <313>: RELEVANT RESIDUES IN SEQ ID NO: (1)..(1535)
taaactgaagagtttgatcatggctcagattgaacgctggcggtatgcttaacacatgcaagtcgaacggtagcaggccttcgggcgctgacgagtggcggacgggtgagtaatgcataggaatctgcctattagtgggggacaacgtggggaaactcacgctaataccgcatacgccctacgggggaaagctggggaccttcgggcctggcgctaatagatgagcctatgtcggattagctagttggtggggtaaaggcctaccaaggcgacgatccgtagctggtctgagaggatgatcagccacactgggactgagacacggcccagactcctacgggaggcagcagtggggaatattggacaatgggcgaaagcctgatccagcaataccgcgtgtgtgaagaaggcctgagggttgtaaagcactttcaataggaaggaatacctatcggttaatacccggtagactgacattacctatacaagaagcaccggctaactccgtgccagcagccgcggtaatacggagggtgcaagcgttaatcggaattactgggcgtaaagcgtgcgtaggcggttgtttaagtcagatgtgaaagccctgggcttaacctgggaactgcatttgatactgggcaactagagtttagtagaggggagtggaatttcaggtgtagcggtgaaatgcgtagagatctgaaggaacaccagtggcgaaggcggctccctggactaaaactgacgctgaggtacgaaagcgtgggtagcaaacaggattagataccctggtagtccacgccgtaaacgatgtcaactaactgttgggttcttaaagaacttagtagtggagctaacgtattaagttgaccgcctggggagtacggccgcaaggctaaaactcaaatgaattgacgggggcccgcacaagcggtggagcatgtggtttaattcgatgcaacgcgaagaaccttacctacccttgacatccagagaatctgttagagatagcggagtgccttcgggaactctgagacaggtgctgcatggctgtcgtcagctcgtgttgtgaaatgttgggttaagtcccgtaacgagcgcaccccttatccttagttgccagcgggtcatgccgggaactctagggagactgccggtgataaaccggaggaaggtggggacgacgtcaagtcatcatggcccttatgggtagggctacacacgtgctacaatggccggtacagagggctgcgaactcgcgagagtaagcgaatcccaaaaagccggtcccagtccggatcgcagtctgcaactcgactgcgtgaagtcggaatcgctagtaatcgcggatcagaatgccgcggtgaatacgttcccgggccttgtacacaccgcccgtcacaccatgggagtgggttgcaaaagaagtaggtagtttaaccttcgggagggcgcttaccactttgtgattcatgactggggtgaagtcgtaacaaggtagccctaggggaacctggggctggatcacctcctta

SEQ ID NO: 5686 - DNA, 1535 bp, Methylomonas sp. LW13
  ref <308>: DATABASE ACCESSION NUMBER: NCBI ACCESSION: NZ_CP033381.1
  ref <309>: DATABASE ENTRY DATE: 2019-04-01
  ref <313>: RELEVANT RESIDUES IN SEQ ID NO: (1)..(1535)
taaactgaagagtttgatcatggctcagattgaacgctggcggtatgcttaacacatgcaagtcgaacggtagcaggccttcgggcgctgacgagtggcggacgggtgagtaatgcataggaatctgcctattagtgggggacaacgtggggaaactcacgctaataccgcatacgccctacgggggaaagctggggaccttcgggcctggcgctaatagatgagcctatgtcggattagctagttggtggggtaaaggcctaccaaggcgacgatccgtagctggtctgagaggatgatcagccacactgggactgagacacggcccagactcctacgggaggcagcagtggggaatattggacaatgggcgaaagcctgatccagcaataccgcgtgtgtgaagaaggcctgagggttgtaaagcactttcaataggaaggaatacctatcggttaatacccggtagactgacattacctatacaagaagcaccggctaactccgtgccagcagccgcggtaatacggagggtgcaagcgttaatcggaattactgggcgtaaagcgtgcgtaggcggttgtttaagtcagatgtgaaagccctgggcttaacctgggaactgcatttgatactgggcaactagagtttagtagaggggagtggaatttcaggtgtagcggtgaaatgcgtagagatctgaaggaacaccagtggcgaaggcggctccctggactaaaactgacgctgaggtacgaaagcgtgggtagcaaacaggattagataccctggtagtccacgccgtaaacgatgtcaactaactgttgggttcttaaagaacttagtagtggagctaacgtattaagttgaccgcctggggagtacggccgcaaggctaaaactcaaatgaattgacgggggcccgcacaagcggtggagcatgtggtttaattcgatgcaacgcgaagaaccttacctacccttgacatccagagaatctgttagagatagcggagtgccttcgggaactctgagacaggtgctgcatggctgtcgtcagctcgtgttgtgaaatgttgggttaagtcccgtaacgagcgcaacccttatccttagttgccagcgggtcatgccgggaactctagggagactgccggtgataaaccggaggaaggtggggacgacgtcaagtcatcatggcccttatgggtagggctacacacgtgctacaatggccggtacagagggctgcgaactcgcgagagtaagcgaatcccaaaaagccggtcccagtccggatcgcagtctgcaactcgactgcgtgaagtcggaatcgctagtaatcgcggatcagaatgccgcggtgaatacgttcccgggccttgtacacaccgcccgtcacaccatgggagtgggttgcaaaagaagtaggtagtttaaccttcgggagggcgcttaccactttgtgattcatgactggggtgaagtcgtaacaaggtagccctaggggaacctggggctggatcacctcctta

SEQ ID NO: 5687 - DNA, 1559 bp, Methylomusa anaerophila
  ref <308>: DATABASE ACCESSION NUMBER: NCBI ACCESSION: NZ_AP018449.1
  ref <309>: DATABASE ENTRY DATE: 2019-04-01
  ref <313>: RELEVANT RESIDUES IN SEQ ID NO: (1)..(1559)
tttattggagagtttgatcctggctcaggacgaacgctggcggcgtgcttaacacatgcaagtcgaacggggagttagcaataactcccagtggcgaacgggtgagtaacgcgtaggcaatctgccttctagatggggacaacaccgcgaaagtggtgctaataccgaatgagatataagagatgcatatcttttataagaaaggtggcctctgaagatgctaccgctagaagatgagcctgcgtctgattagctagttggtgaggtaacggctcaccaaggcgacgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggactgtaaaactctgtcttgagggacgaacgtattataggtaaagaatctatgataatgacggtacctgaggaggaagccacggctaactacgtgccagcagccgcggtaatacgtaggtggcaagcgttgtccggaattattgggcgtaaagggcgcgcaggcgggtctttaagtcgaaagtctaagtgcggggctcaaccccgtatgggcgttggaaactggagaccttgagtgcaggagaggaaagtggaattcccagtgtagcggtgaaatgcgtagagattgggaggaacaccagtggcgaaggcgactttctggactgtgtctgacgctgaggcgcgaaagccaggggagcgaacgggattagataccccggtagtcctggccgtaaacgatgggtactaggtgtagaaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccagggcttgacatcgattggaacattcagagatggatgcctctcttcggagacaagaagacaggtggtgcatggctgtcgtcagctcgtgtcgtgagatgttgggttaagtcccgcaacgagcgcaacccttatcctttgttgccagcgcgtaaaggtgggaactcaaaggagactgccgcagagaatgcggaggaaggcggggatgacgtcaagtcatcatgccccttatgtcctgggctacacacgtactacaatgggcttcaacagagagaagcgaagccgcgaggtggagccaagctcacaaacaagctctcagttcggatcggaggctgcaactcgcctccgtgaagtcggaatcgctagtaatcgcaggtcagcatactgcggtgaatacgttcccgggccttgtacacaccgcccgtcacaccacgagagttggaaacacccgaagccggtgaggtaactgaaaagagccagccgtcgaaggtggggccgatgattggggtgaagtcgtaacaaggtagccgtatcggaaggtgcggctggatcacctcctttctaggga

SEQ ID NO: 5688 - DNA, 1545 bp, Methylophilaceae bacterium
  ref <308>: DATABASE ACCESSION NUMBER: NCBI ACCESSION: NZ_RJVP01000011.1
  ref <309>: DATABASE ENTRY DATE: 2019-04-01
  ref <313>: RELEVANT RESIDUES IN SEQ ID NO: (1)..(1545)
attaaactgaagagtttgatcctggctcagattgaacgctggcggaatgctttacacatgcaagtcgaacgggcttaaggggcttgctccttaagttagtggcgaacgggtgagtaatatatcggaacgtatccaatagtgggggataacgagtcgaaagattcgctaataccgcatacgccctgagggggaaagtgggggaccgcaaggcctcacgctaatggagcggccgatatctgattagctagttggtgaggtaaaggctcaccaaggcgacgatcagtagctggtctgagaggacgaccagccacactggaactgagacacggtccagactcctacgggaggcagcagtggggaattttggacaatgggcgaaagcctgatccagccattccgcgtgagtgaagaaggccttcgggttgtaaagctctttcgcaagggaagaaagattactttttaataaagagtgattatgacggtaccttgataagaagcaccggctaactacgtgccagcagccgcggtaatacgtagggtgcgagcgttaatcggaattactgggcgtaaagcgagcgcaggcggttctgcaagtcagatgtgaaatccccgggctcaacctgggaactgcgtttgaaactacagagctagagtataggagagggaggtagaattccacgtgtagcagtgaaatgcgtagagatgtggaggaataccgatggcgaaggcagcctcctggcctaatactgacgctcatgctcgaaagcgtggggagcaaacaggattagataccctggtagtccacgccctaaacgatgtctactagttgttggtggagtaaaatccattagtaacgcagctaacgcgtgaagtagaccgcctggggagtacggtcgcaagattaaaactcaaaggaattgacgggggcccgcacaagcggtggattatgtggattaattcgatgcaacgcgaaaaaccttacctggccttgacatgtacggaactttccagagatggattggtgctcgaaagagagccgtaacacaggtgctgcatggctgtcgtcagctcgtgtcgtgagatgttgggttaagtcccgcaacgagcgcaacccttgccaataattgccatcatttagttgggcactttattgggactgccggtgacaaaccggaggaaggtggggatgacgtcaagtcctcatggcccttatggccagggcttcacacgtaatacaatggtcggtacagagggttgccaacccgcgagggggagccaatcccagaaagccgatcgtagtccggattgcagtctgcaactcgactgcatgaagtcggaatcgctagtaatcgcggatcagcatgtcgcggtgaatacgttcccgggccttgtacacaccgcccgtcacaccatgggagtgggtttcaccagaagtaggtagcctaaccgtaaggagggcgcttaccacggtgggattcatgactggggtgaagtcgtaacaaggtagccgtatcggaaggtgcggctggatcacctcctttctag

SEQ ID NO: 5689 - DNA, 1546 bp, Methylophilales bacterium LSUCC0135
  ref <308>: DATABASE ACCESSION NUMBER: NCBI ACCESSION: NZ_MCAW01000025.1
  ref <309>: DATABASE ENTRY DATE: 2019-04-01
  ref <313>: RELEVANT RESIDUES IN SEQ ID NO: (1)..(1546)
attaaactgaagagtttgatcctggctcagattgaacgctggcggaatgctttacacatgcaagtcgaacggcagcacgggagcttgctcctggtggcgagtggcgaacgggtgagtaacatatcggaacgtacccagtaatgggggataactagtcgaaagattagctaataccgcatacgccctgagggggaaagcgggggatcgaaagacctcgcgttattggagcggccgatatctgattagctagttggtggggtaaaggcccaccaaggcgacgatcagtagctggtctgagaggacgaccagccacactggaactgagacacggtccagactcctacgggaggcagcagtggggaattttggacaatgggcgcaagcctgatccagccattccgcgtgagtgaagaaggccttcgggttgtaaagctctttcgcaagggaagaaaacttaccttttaataaagggtgaggttgacggtaccttgataagaagcaccggctaactacgtgccagcagccgcggtaatacgtagggtgcgagcgttaatcggaattactgggcgtaaagcgtgcgcaggcggttttgtaagtcagatgtgaaatccccgggctcaacctgggaactgcgtttgaaactgcaaggctagagtgtagcagaggggggtagaattccacgtgtagcagtgaaatgcgtagagatgtggaggaataccaatggcgaaggcagccccctgggttaacactgacgctcatgcacgaaagcgtggggagcaaacaggattagataccctggtagtccacgccctaaacgatgtcaactagttgttggtggagtaaaatccattagtaacgcagctaacgcgtgaagttgaccgcctggggagtacggtcgcaagattaaaactcaaaggaattgacgggggcccgcacaagcggtggattatgtggattaattcgatgcaacgcgaaaaaccttacctggccttgacatgtacggaactttccagagatggattggtgctcgaaagagagccgtaacacaggtgctgcatggctgtcgtcagctcgtgtcgtgagatgttgggttaagtcccgcaacgagcgcaacccttgccattaattgccatcattcagttgggcactttaatgggactgccggtgacaaaccggaggaaggtggggatgacgtcaagtcctcatggcccttatggccagggcttcacacgtaatacaatggtcggtacagagggttgccaacccgcgagggggagccaatcccagaaagccgatcgtagtccggattgcagtctgcaactcgactgcatgaagtcggaatcgctagtaatcgcggatcagcatgtcgcggtgaatacgttcccgggccttgtacacaccgcccgtcacaccatgggagtgggttccaccagaagtaggtagtctaaccgcaaggaggacgcttaccacggtggggttcatgactggggtgaagtcgtaacaaggtagccgtatcggaaggtgcggctggatcacctcctttcta

SEQ ID NO: 5690 - DNA, 1495 bp, Methylopila sp. 73B
  ref <308>: DATABASE ACCESSION NUMBER: NCBI ACCESSION: NZ_JAFV01000001.1
  ref <309>: DATABASE ENTRY DATE: 2019-04-01
  ref <313>: RELEVANT RESIDUES IN SEQ ID NO: (1)..(1495)
ttcaacctgagagtttgatcctggctcagaacgaacgctggcggcaggcttaacacatgcaagtcgagcgccttagcaatagggagcggcagacgggtgagtaacgcgtggggatgtgcctggtggtacggaacaactcagggaaacttgagctaatgccgtataagcccttcgggggaaagatttatcgccaccagatcaacccgcgttggattagctagttggtgaggtaacggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcactggggaagataatgacggtacccagagaagaagccccggctaacttcgtgccagcagccgcggtaatacgaagggggctagcgttgttcggaatcactgggcgtaaagcgcacgtaggcggacttttaagtcaggggtgaaatcccaaggctcaaccttggaactgcctttgatactggaagtcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacaggattagataccctggtagtccacgccgtaaacgatggaagctagccgttggtcagcatgctgatcagtggcgcagctaacgctttaagcttcccgcctggggagtacggtcgcaagattaaaactcaaaggaattgacgggggcccgcacaagcggtggagcatgtggtttaattcgaagcaacgcgcagaaccttaccagctcttgacatcccgtgctactcagagagatttgaggttcccttcggggacgcggagacaggtgctgcatggctgtcgtcagctcgtgtcgtgagatgttgggttaagtcccgcaacgagcgcaaccttcgcccctagttgccatcattcagttgggcactctagggggactgccggtgataagccgcgaggaaggtggagatgacgtcaagtcctcatggcccttacgggctgggctacacacgtgctacaatggcggtgacagtgggcagcgaaggagcgatccggagctaatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggttttacccgaaggcgctgcgctaacccagcaatgggaggcaggcgaccacggtagggtcagcgactggggtgaagtcgtaacaaggtagccgtaggggaacctgcggctggatcacctcctttctaagg

SEQ ID NO: 5691 - DNA, 1491 bp, Methylopila sp. M107
  ref <308>: DATABASE ACCESSION NUMBER: NCBI ACCESSION: NZ_ARWB01000001.1
  ref <309>: DATABASE ENTRY DATE: 2019-04-01
  ref <313>: RELEVANT RESIDUES IN SEQ ID NO: (1)..(1491)
ttcaacctgagagtttgatcctggctcagaacgaacgctggcggcaggcttaacacatgcaagtcgagcgcgtagcaatacgagcggcagacgggtgagtaacgcgtggggatgtgcctggtggtacggaacaactcagggaaacttgagctaataccgtataagcccttagggggaaagatttatcgccaccagatcaacccgcgttggattagctagttggtgaggtaacggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcactggggaagataatgacggtacccagagaagaagccccggctaacttcgtgccagcagccgcggtaatacgaagggggctagcgttgttcggaatcactgggcgtaaagcgcacgtaggcggacttttaagtcaggggtgaaatcccaaggctcaaccttggaactgcctttgatactggaagtcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacaggattagataccctggtagtccacgccgtaaacgatggaagctagccgttggtcagcatgctgatcagtggcgcagctaacgctttaagcttcccgcctggggagtacggtcgcaagattaaaactcaaaggaattgacgggggcccgcacaagcggtggagcatgtggtttaattcgaagcaacgcgcagaaccttaccagcctttgacatcctgtgttacccagagagatttggggtccacttcggtggcgcagagacaggtgctgcatggctgtcgtcagctcgtgtcgtgagatgttgggttaagtcccgcaacgagcgcaaccttcgcccctagttgccagcattaagttgggcactctagggggactgccggtgataagccgcgaggaaggtgaagatgacgtcaagtcctcatggcccttacgggctgggctacacacgtgctacaatggcggtgacaatgggcagcgaaggggtgacccggagctaatctccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggcgttgcgctaacccgcaagggaggcaggcgaccacggtagggtcagcgactggggtgaagtcgtaacaaggtagccgtaggggaacctgcggctggatcacctcctttctaagg

SEQ ID NO: 5692 - DNA, 1487 bp, Methylopila sp. Yamaguchi
  ref <308>: DATABASE ACCESSION NUMBER: NCBI ACCESSION: NZ_BAUX01000032.1
  ref <309>: DATABASE ENTRY DATE: 2019-04-01
  ref <313>: RELEVANT RESIDUES IN SEQ ID NO: (1)..(1487)
tcaacctgagagtttgatcctggctcagaacgaacgctggcggcaggcttaacacatgcaagtcgagcgccccgcaaggggagcggcagacgggtgagtaacgcgtggggatgtgcctggtggtacggaacaactcagggaaacttgagctaatgccgtataagcccttcgggggaaagatttatcgccaccagatcaacccgcgttggattagctagttggtgaggtaacggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcactggggaagataatgacggtacccagagaagaagccccggctaacttcgtgccagcagccgcggtaatacgaagggggctagcgttgttcggaatcactgggcgtaaagcgcacgtaggcggacttttaagtcaggggtgaaatcccaaggctcaaccttggaactgcctttgatactggaagtcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacaggattagataccctggtagtccacgccgtaaacgatggaagctagccgttggtcagcatgctgatcagtggcgcagctaacgctttaagcttcccgcctggggagtacggtcgcaagattaaaactcaaaggaattgacgggggcccgcacaagcggtggagcatgtggtttaattcgaagcaacgcgcagaaccttaccagctcttgacatcccgtgctactcagagagatttgaggttcccttcggggacgcggagacaggtgctgcatggctgtcgtcagctcgtgtcgtgagatgttgggttaagtcccgcaacgagcgcaaccttcgcccctagttgccatcattcagttgggcactctagggggactgccggtgataagccgcgaggaaggtgaagatgacgtcaagtcctcatggcccttacgggctgggctacacacgtgctacaatggcggtgacagtgggcagcgaaggagcgatccggagctaatctccaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttcta

SEQ ID NO: 5693 - DNA, 1526 bp, Methylorubrum extorquens
  ref <308>: DATABASE ACCESSION NUMBER: NCBI ACCESSION: NZ_LT962688.1
  ref <309>: DATABASE ENTRY DATE: 2019-04-01
  ref <313>: RELEVANT RESIDUES IN SEQ ID NO: (1)..(1526)
ctccgtttatgttgtgatcagctgagatcaactcttcaacttgagagtttgatcctggctcagagcgaacgctggcggcaggcttaacacatgcaagtcgaacgggcaccttcgggtgtcagtggcagacgggtgagtaacacgtgggaacgtacccttcggttcggaataactcaggggaaacttgagctaataccggatacgcccttttggggaaaggtttactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacggggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaagccgcgaggtggagcaaatccccaaaaaccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5694 - DNA, 1524 bp, Methylorubrum zatmanii
  ref <308>: DATABASE ACCESSION NUMBER: NCBI ACCESSION: NZ_CP021054.1
  ref <309>: DATABASE ENTRY DATE: 2019-04-01
  ref <313>: RELEVANT RESIDUES IN SEQ ID NO: (1)..(1524)
ctccgtttatgttgtgatcagctgagatcaactcttcaacttgagagtttgatcctggctcagagcgaacgctggcggcaggcttaacacatgcaagtcgaacgggcaccttcgggtgtcagtggcagacgggtgagtaacacgtgggaacgtacccttcggttcggaataactcagggaaacttgagctaataccggatacgcccttttggggaaaggtttactgccgaaggatcggcccgcgtctgattagcttgttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggacgataatgacggtaccggaagaataagccccggctaacttcgtgccagcagccgcggtaatacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacaggattagataccctggtagtccacgccgtaaacgatgaatgccagccgttggcctgcttgcaggtcagtggcgccgctaacgcattaagcattccgcctggggagtacggtcgcaagattaaaactcaaaggaattgacgggggcccgcacaagcggtggagcatgtggtttaattcgaagcaacgcgcagaaccttaccatcccttgacatggcatgttacctcgagagatcggggatcctcttcggaggcgtgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaagccgcgaggtggagcaaatccccaaaaaccgtctcagttcggattgcactctgcaactcgggtgcatgaaggcggaatcgctagtaatcgtggatcagcacgccacggtgaatacgttcccgggccttgtacacaccgcccgtcacaccatgggagttggtcttacccgacggcgctgcgccaaccgcaaggaggcaggcgaccacggtagggtcagcgactggggtgaagtcgtaacaaggtagccgtaggggaacctgcggctggatcacctcctttcta

SEQ ID NO: 5695 - DNA, 1495 bp, Methylosinus sp. 3S-1
  ref <308>: DATABASE ACCESSION NUMBER: NCBI ACCESSION: NZ_LXWX01000071.1
  ref <309>: DATABASE ENTRY DATE: 2019-04-01
  ref <313>: RELEVANT RESIDUES IN SEQ ID NO: (1)..(1495)
tgaacttgagagtttgatcctggctcagaacgaacgctggcggcaggcttaacacatgcaagtcgaacgggcgcagcgatgcgtcagtggcagacgggtgagtaacgcgtgggaacgtacctttcggttcggaataactcagggaaacttgagctaataccggatacgcccttagggggaaagatttattgccgaaagatcggcccgcgtccgattagctagttggtgaggtaaaggctcaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggaatcactgggcgtaaagcgcacgtaggcggattgttaagtcaggggtgaaatcccgaggctcaacctcggaactgcctttgatactggcgatctagagtccgggagaggtgagtggaactgcgagtgtagaggtgaaattcgtagatattcgcaagaacaccagtggcgaaggcggctcactggcccggaactgacgctgaggtgcgaaagcgtggggagcaaacaggattagataccctggtagtccacgccgtaaacgatggatgctagccgttggggagcttgctcttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgtccggtatggtcgtcagagatgacttccttcccgcaaggggccggaacacaggtgctgcatggctgtcgtcagctcgtgtcgtgagatgttgggttaagtcccgcaacgagcgcaaccctcgcccttagttgccatcattcagttgggcactctagggggactgccggtgataagccgcgaggaaggtggggatgacgtcaagtcctcatggcccttacaggctgggctacacacgtgctacaatggcggtgacaatgggaagcgaaggggtgacccggagcaaatctccaaaagccgtctcagttcggattgcactctgcaactcgagtgcatgaaggtggaatcgctagtaatcgcagatcagcacgctgcggtgaatacgttcccgggccttgtacacaccgcccgtcacaccatgggagttggctttacccgaaggcgtttcgctaaccgcaaggaggcagacgaccacggtagggtcagcgactggggtgaagtcgtaacaaggtagccgtaggggaacctgcggctggatcacctcctttctaagg

SEQ ID NO: 5696 - DNA, 1494 bp, Methylosinus sp. LW3; identical to SEQ ID NO: 5676
  ref <308>: DATABASE ACCESSION NUMBER: NCBI ACCESSION: NZ_AZUO01000001.1
  ref <309>: DATABASE ENTRY DATE: 2019-04-01
  ref <313>: RELEVANT RESIDUES IN SEQ ID NO: (1)..(1494)

SEQ ID NO: 5697 - DNA, 1494 bp, Methylosinus sp. LW4
  ref <308>: DATABASE ACCESSION NUMBER: NCBI ACCESSION: NZ_KB900626.1
  ref <309>: DATABASE ENTRY DATE: 2019-04-01
  ref <313>: RELEVANT RESIDUES IN SEQ ID NO: (1)..(1494)
ttcaacttgagagtttgatcctggctcagaacgaacgctggcggcaggcctaacacatgcaagtcgaacgctgtagcaatacagagtggcagacgggtgagtaacgcgtgggaacgtgcctttcggttcggaataactcagggaaacttgagctaataccggatacgcccttcgggggaaagatttattgccgaaagatcggcccgcgtccgattagctagttggtgaggtaacggcccaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggaatcactgggcgtaaagcgcacgtaggcggatctttaagtcaggggtgaaatcccgaggctcaacctcggaactgcctttgatactggaggtctagagtccgggagaggtgagtggaactgcgagtgtagaggtgaaattcgtagatattcgcaagaacaccagtggcgaaggcggctcactggcccggaactgacgctgaggtgcgaaagcgtggggagcaaacaggattagataccctggtagtccacgccgtaaacgatggatgctagccgttgggcagcttgctgttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcccggtatgatcgccagagatggctttcttcccgcaaggggccggtgcacaggtgctgcatggctgtcgtcagctcgtgtcgtgagatgttgggttaagtcccgcaacgagcgcaaccctcgcccttagttgccatcattcagttgggcactctagggggactgccggtgataagccgcgaggaaggtggggatgacgtcaagtcctcatggcccttacaggctgggctacacacgtgctacaatggcggtgacaatgggacgcgaaggggcgacccttagcaaatctcaaaaaaccgtctcagttcggattgcactctgcaactcgagtgcatgaaggtggaatcgctagtaatcgcagatcagcacgctgcggtgaatacgttcccgggccttgtacacaccgcccgtcacaccatgggagttggctttacccgaaggcgtttcgctaaccgcaaggaggcagacgaccacggtagggtcagcgactggggtgaagtcgtaacaaggtagccgtaggggaacctgcggctggatcacctcctttctaagg

SEQ ID NO: 5698 - DNA, 1496 bp, Methylosinus sp. PW1
  ref <308>: DATABASE ACCESSION NUMBER: NCBI ACCESSION: NZ_JQNK01000004.1
  ref <309>: DATABASE ENTRY DATE: 2019-04-01
  ref <313>: RELEVANT RESIDUES IN SEQ ID NO: (1)..(1496)
ttcaacttgagagtttgatcctggctcagaacgaacgctggcggcaggcctaacacatgcaagtcgagcgattgcagcaatgcaggagcggcagacgggtgagtaacgcgtgggaacgtgcctttcggttcggaataactcagggaaacttgagctaataccggatacgcccttcgggggaaagatttattgccgaaagatcggcccgcgtccgattagctagttggtgaggtaacggcccaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggaatcactgggcgtaaagcgcacgtaggcggatctttaagtcaggggtgaaatcccgaggctcaacctcggaactgcctttgatactgggggtctagagtccgggagaggtgagtggaactgcgagtgtagaggtgaaattcgtagatattcgcaagaacaccagtggcgaaggcggctcactggcccggaactgacgctgaggtgcgaaagcgtggggagcaaacaggattagataccctggtagtccacgccgtaaacgatggatgctagccgttgggcagcttgctgttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgcccggtatgatcgccagagatggctttcttcccgcaaggggccggtgcacaggtgctgcatggctgtcgtcagctcgtgtcgtgagatgttgggttaagtcccgcaacgagcgcaaccctcgcccttagttgccatcattcagttgggcactctagggggactgccggtgataagccgcgaggaaggtggggatgacgtcaagtcctcatggcccttacaggctgggctacacacgtgctacaatggcggtgacaatgggacgcgaaggggcgacccttagcaaatctcaaaaaaccgtctcagttcggattgcactctgcaactcgagtgcatgaaggtggaatcgctagtaatcgcagatcagcacgctgcggtgaatacgttcccgggccttgtacacaccgcccgtcacaccatgggagttggctttacccgaaggcgtttcgctaaccgcaaggaggcagacgaccacggtagggtcagcgactggggtgaagtcgtaacaaggtagccgtaggggaacctgcggctggatcacctcctttctaagg

SEQ ID NO: 5699 - DNA, 1494 bp, Methylosinus sp. R-45379; identical to SEQ ID NO: 5676
  ref <308>: DATABASE ACCESSION NUMBER: NCBI ACCESSION: NZ_LUUM01000190.1
  ref <309>: DATABASE ENTRY DATE: 2019-04-01
  ref <313>: RELEVANT RESIDUES IN SEQ ID NO: (1)..(1494)

SEQ ID NO: 5700 - DNA, 1490 bp, Methylosinus trichosporium
  ref <308>: DATABASE ACCESSION NUMBER: NCBI ACCESSION: NZ_CP023737.1
  ref <309>: DATABASE ENTRY DATE: 2019-04-01
  ref <313>: RELEVANT RESIDUES IN SEQ ID NO: (1)..(1490)
gaacttgagagtttgatcctggctcagaacgaacgctggcggcaggcttaacacatgcaagtcgaacgggcgcagcgatgcgtcagtggcagacgggtgagtaacgcgtgggaacgtacctttcggttcggaataactcagggaaacttgagctaataccggatacgcccttagggggaaagatttattgccgaaagatcggcccgcgtccgattagctagttggtgaggtaaaggctcaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcgccagggacgataatgacggtacctggataagaagccccggctaacttcgtgccagcagccgcggtaatacgaagggggctagcgttgttcggaatcactgggcgtaaagcgcacgtaggcggattgttaagtcaggggtgaaatcccgaggctcaacctcggaactgcctttgatactggcgatctagagtccgggagaggtgagtggaactgcgagtgtagaggtgaaattcgtagatattcgcaagaacaccagtggcgaaggcggctcactggcccggaactgacgctgaggtgcgaaagcgtggggagcaaacaggattagataccctggtagtccacgccgtaaacgatggatgctagccgttggggagcttgctcttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcttttgacatgtccggtatggtcgtcagagatgacttccttcccgcaaggggccggaacacaggtgctgcatggctgtcgtcagctcgtgtcgtgagatgttgggttaagtcccgcaacgagcgcaaccctcgcccttagttgccatcattcagttgggcactctagggggactgccggtgataagccgcgaggaaggtggggatgacgtcaagtcctcatggcccttacaggctgggctacacacgtgctacaatggcggtgacaatgggaagcgaaggggtgacccggagcaaatctccaaaagccgtctcagttcggattgcactctgcaactcgagtgcatgaaggtggaatcgctagtaatcgcagatcagcacgctgcggtgaatacgttcccgggccttgtacacaccgcccgtcacaccatgggagttggctttacccgaaggcgtttcgctaaccgcaaggaggcagacgaccacggtagggtcagcgactggggtgaagtcgtaacaaggtagccgtaggggaacctgcggctggatcacctcctttct

SEQ ID NO: 5701 - DNA, 1537 bp, Methyloterricola oryzae
  ref <308>: DATABASE ACCESSION NUMBER: NCBI ACCESSION: NZ_JYNS01000046.1
  ref <309>: DATABASE ENTRY DATE: 2019-04-01
  ref <313>: RELEVANT RESIDUES IN SEQ ID NO: (1)..(1537)
aaactgaagagtttgatcatggctcagattgaacgctggcggcatgcttaacacatgcaagtcgaacggtaacaggccttcgggtgctgacgagtggcggacgggtgagtaacgcgtaggaatctgcccacgggtgggggataactctccgaaaggagagctaataccgcataagaccttagggtgaaagcgggggatcttcggacctcgcgccggtggatgagcctgcgtcggattagctagttggtagggtaaaggcctaccaaggcgacgatccgtagctggtctgagaggacgaccagccacactgggactgagacacggcccagactcctacgggaggcagcagtggggaatattggacaatgggggcaaccctgatccagcaatgccgcgtgtgtgaagaaggcctgcgggttgtaaagcactttgagtgggaaagaagggttctaggttaataccctgggacattgacgttacccacagaacaagcaccggctaactccgtgccagcagccgcggtaatacggagggtgcgagcgttaatcggaattactgggcgtaaagcgcgcgtaggcggtttgttaagtttgatgtgaaagccctgggcttaacctgggaacggcattggatactggcaagctggagtgtggtagaggggtgtggaatttccggtgtagcagtgaaatgcgtagagatcggaaggaacaccagtggcgaaggcggcaccctggaccaacactgacgctgaggtgcgaaagcgtggggagcaaacaggattagataccctggtagtccacgcggtaaacgatgtcaactagccgttgggcgcgattaagtgttcagtggcgcagctaacgcgataagttgaccgcctggggagtacggccgcaaggttaaaactcaaatgaattgacgggggcccgcacaagcggtggagcatgtggtttaattcgatgcaacgcgaagaaccttacctggccttgacatgcttggaatcctgcagagatgtgggagtgccttcgggagccaagacacaggtgctgcatggctgtcgtcagctcgtgtcgtgagatgttgggttaagtcccgtaacgagcgcaacccttgtccttagttgccagcgggtaatgccgggaactctaaggagaccgccggtgataaaccggaggaaggtggggatgacgtcaagtcatcatggcccttatggccagggctacacacgtgctacaatggtcggtacagagggccgcgaagccgcgaggtggagcaaatcccagaaagccgatcttagtccggattgcagtctgcaactcgactgcatgaagtcggaatcgctagtaatcgcgaatcagaatgtcgcggtgaatacgttcccgggccttgtacacaccgcccgtcacaccatgggagtgggttgcaccagaagtaggtagtctaaccgcaaggggggcgcttaccacggtgtgattcatgactggggtgaagtcgtaacaaggtagccgtaggggaacctgcggctggatcacctccttta

SEQ ID NO: 5702 - DNA, 1539 bp, Methyloversatilis discipulorum
  ref <308>: DATABASE ACCESSION NUMBER: NCBI ACCESSION: NZ_AZUP01000001.1
  ref <309>: DATABASE ENTRY DATE: 2019-04-01
  ref <313>: RELEVANT RESIDUES IN SEQ ID NO: (1)..(1539)
attaaactgaagagtttgatcctggctcagattgaacgctggcggaatgctttacacatgcaagtcgagcggcagcgcggtcttcggactggcggcgagcggcgaacgggtgagtaatacatcggaacatgcccagtcgtgggggataacacttcgaaagaagtgctaataccgcatacgtcctgagggagaaagcgggggatcgcaagacctcgcgcgattggagtggccgatgtcagattagctagttggtggggtaaaggcctaccaaggcaacgatctgtagctggtctgagaggatgatcagccacactgggactgagacacggcccagactcctacgggaggcagcagtggggaattttggacaatgggggcaaccctgatccagccattccgcgtgagtgaagaaggccttcgggttgtaaagctctttcggcaggaacgaaacggtgagctctaacatagctcgctaatgacggtacctgaagaagaagcaccggctaactacgtgccagcagccgcggtaatacgtagggtgcgagcgttaatcggaattactgggcgtaaagcgtgcgcaggcggttgtgtaagacaggtgtgaaatccccgggcttaacctgggaactgcgcttgtgactgcacggctagagtatggcagaggggggtggaattccacgtgtagcagtgaaatgcgtagagatgtggaggaacaccgatggcgaaggcagccccctgggccaatactgacgctcatgcacgaaagcgtggggagcaaacaggattagataccctggtagtccacgccctaaacgatgtcgactaggtgttcggtgaggagactcattgagtaccgcagctaacgcgtgaagtcgaccgcctggggagtacggtcgcaagattaaaactcaaaggaattgacggggacccgcacaagcggtggatgatgtggattaattcgatgcaacgcgaaaaaccttacctacccttgacatgtacggaaccctgctgagaggtgggggtgctcgaaagagagccgtaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcggtacagagggttgccaagccgcgaggtggagccaatcccagaaagccgatcgtagtccggatcgcagtctgcaactcgactgcgtgaagtcggaatcgctagtaatcgcggatcagcatgccgcggtgaatacgttcccgggtcttgtacacaccgcccgtcacaccatgggagtgggtttcaccagaagaggctagcctaaccgtaaggggggcggtcgccacggtgagattcatgactggggtgaagtcgtaacaaggtagccgtatcggaaggtgcggctggatcacctcctttcta

SEQ ID NO: 5703 - DNA, 1539 bp, Methyloversatilis thermotolerans
  ref <308>: DATABASE ACCESSION NUMBER: NCBI ACCESSION: NZ_KB889967.1
  ref <309>: DATABASE ENTRY DATE: 2019-04-01
  ref <313>: RELEVANT RESIDUES IN SEQ ID NO: (1)..(1539)
attgaactgaagagtttgatcctggctcagattgaacgctggcggaatgctttacacatgcaagtcgagcggcagcgcggtcttcggactggcggcgagcggcgaacgggtgagtaatacatcggaacgtacccagtcgtgggggataacacttcgaaagaagtgctaataccgcatacgtcctgagggagaaagcgggggatcgcaagacctcgcgcgattggagcggccgatgtcagattagctagttggtggggtaaaggcctaccaaggcaacgatctgtagctggtctgagaggatgatcagccacactgggactgagacacggcccagactcctacgggaggcagcagtggggaattttggacaatgggggcaaccctgatccagccattccgcgtgagtgaagaaggccttcgggttgtaaagctctttcggcaggaacgaaacggcgggctctaacatagcccgttaatgacggtacctgaagaagaagcaccggctaactacgtgccagcagccgcggtaatacgtagggtgcgagcgttaatcggaattactgggcgtaaagcgtgcgcaggcggttgtgtaagacaggtgtgaaatccccgggcttaacctgggaactgcgcttgtgactgcacggctagagtacggcagagggaggtggaattccacgtgtagcagtgaaatgcgtagagatgtggaggaacaccgatggcgaaggcagcctcctgggccagtactgacgctcatgcacgaaagcgtggggagcaaacaggattagataccctggtagtccacgccctaaacgatgtcgactagttgttcggtgaggagactcattgagtaacgcagctaacgcgtgaagtcgaccgcctggggagtacggtcgcaagattaaaactcaaaggaattgacggggacccgcacaagcggtggatgatgtggattaattcgatgcaacgcgaaaaaccttacctacccttgacatgtacggaaccctgctgagaggtgggggtgctcgaaagagagccgtaacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtcggtacagagggttgccaagccgcgaggtggagccaatcccagaaagccgatcgtagtccggatcgcagtctgcaactcgactgcgtgaagtcggaatcgctagtaatcgcggatcagcatgccgcggtgaatacgttcccgggtcttgtacacaccgcccgtcacaccatgggagtgggtttcaccagaagaggctagcctaaccgtaaggggggcggtcgccacggtgagattcatgactggggtgaagtcgtaacaaggtagccgtatcggaaggtgcggctggatcacctcctttcta

SEQ ID NO: 5704 - DNA, 1490 bp, Methylovirgula ligni
  ref <308>: DATABASE ACCESSION NUMBER: NCBI ACCESSION: NZ_CP025086.1
  ref <309>: DATABASE ENTRY DATE: 2019-04-01
  ref <313>: RELEVANT RESIDUES IN SEQ ID NO: (1)..(1490)
tcaacttgagagtttgatcctggctcagaacgaacgctggcggcaggcttaacacatgcaagtcgaacgctgtagcaatacagagtggcagacgggtgagtaacacgtgggaacatacccttcggttcggaataactcagggaaacttgagctaataccggatacgtccgcgaggagaaagattcatcgccgaaggattggcccgcgtctgattagctagttggtgaggtaacggctcaccaaggcgacgatcagtagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctcttttacccgggaagataatgacggtaccgggagaataagccccggctaacttcgtgccagcagccgcggtaatacgaagggggctagcgttgttcggatttactgggcgtaaagcgcacgtaggcggattcttaagtcaggggtgaaatcccgaggctcaacctcggaactgcctttgatactggggatcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacaggattagataccctggtagtccacgccgtaaactatggatgctagccgttaggcagcttgctgcttagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcctttgacatgcctcggacggttaccagagatggtttcttctcttcggagccggggacacaggtgctgcatggctgtcgtcagctcgtgtcgtgagatgttgggttaagtcccgcaacgagcgcaaccctcgcccttagttgccatcatttagttgggcactctagggggactgccggtgataagccgcgaggaaggtggggatgacgtcaagtcctcatggcccttacaggctgggctacacacgtgctacaatggcggtgacaatgggacgcaaaggggtgacccctagcaaatctcaaaaagccgtctcagttcagattgtactctgcaactcgagtacatgaaggtggaatcgctagtaatcgtagatcagaacgctacggtgaatacgttcccgggccttgtacacaccgcccgtcacaccatgggagttggttctacccgaaggcgttttcttaaccgcaaggagagagacgaccacggtagggtcagcgactggggtgaagtcgtaacaaggtagccgtaggggaacctgcggctggatcacctcctttctaa

SEQ ID NO: 5705 - DNA, 1491 bp, Methylovirgula sp. 4M-Z18
  ref <308>: DATABASE ACCESSION NUMBER: NCBI ACCESSION: NZ_QUOY01000019.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcaggcttaacacatgcaagtcgaacgggcatagcaatatgtcagtggcagacgggtgcgtaacacgtgggaacataccttttggttcggaataacttggggaaacttaagctaataccggataagcccttcgggggaaagatttattgccgaaagattggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccttagggttgtaaagctcttttacctgggaagataatgactgtaccaggagaataagccccggctaacttcgtgccagcagccgcggtaatacgaagggggctagcgttgttcggaatcactgggcgtaaagcgcacgtaggcggacttttaagtcaggggtgaaatcctgaggctcaacctcagaactgcctttgatactgggagtcttgaattcgagagaggtaagtggaattggtagtgtagaggtgaaattcgtagatattaccaggaacaccagtggcgaaggcggcttactggctcgatattgacgctgaggtgcgaaagcgtggggatcaaacaggattagataccctggtagtccacgctgtaaacgatgaatgctagccgttggggagcttgctcttcagtggcgccgttaacacattaagcattccgcctggggagtacggtcgcaagattaaaactcaaaggaattgacgggggcccgcacaagcggtggagcatgtggtttaattcgaagcaacgcgcagaaccttaccagcttttgacatgccttggacggatactggagacagtttcttctcttcggagccagggacacaggtgctgcatggctgtcgtcagctcgtgtcgtgagatgttgggttaagtcccgcaacgagcgcaaccctcgcccttagttgccatcattcagttgggcactctagggggactgccggtgataagccgcgaggaaggtggggatgacgtcaagtcctcatggcccttacaggctgggctacacacgtgctacaatggcggtaacaatgggacgcgaaagggtgacctctagcaaatctcaaaaagccgtctcagttcggattgtactctgcaattcgagtacatgaagttggaatcgctagtaatcgtagatcagaacgctacggtgaatacgttcccgggccttgtacacaccgcccgtcacaccatgggagttggttttacccgaaggcgtttcgctaaccgcaaggaggcagacgaccacggtagggtcagcgactggggtgaagtcgtaacaaggtagccgtaggggaacctgcggctggatcacctcctttctaag

SEQ ID NO: 5706 - DNA, 1494 bp, Micavibrio aeruginosavorus
  ref <308>: DATABASE ACCESSION NUMBER: NCBI ACCESSION: NC_020812.1
  ref <309>: DATABASE ENTRY DATE: 2019-04-01
  ref <313>: RELEVANT RESIDUES IN SEQ ID NO: (1)..(1494)
tcaaacttgagagtttgatcctggctcagaacgaacgctggcggcaggcctaatacatgcaagtcgaacgccccgcaaggggagtggcgcacgggtgagtaacgcgtgggaatgtgcccttaggtgcggaacaacgtttggaaacgaacgctaataccgcataatatctccggatcaaagatttatcgcctagggatcagcccgcgttggattagctagttggtggggtaacggcctaccaaggcgacgatccatagctggtctgagaggatgatcagccacactgggactgagacacggcccagactcctacgggaggcagcagtaaggaatattggacaatggaggaaactctgatccagccatgccgcgtgagtgatgaaggccttcgggttgtaaagctcttttaggtgtgaaaatgatgatggtagcaccagaaaaagctccggctaacttcgtgccagcagccgcggtaatacgaagggagcgagcgttgttcggaatcactgggcgtaaagcgtgcgtaggcggttttgtaagacagaagtgaaatcctggagcttaactccagaattgcttttgtgactgcaaagcttgaatccaggagaggttgggggaattccgagtgtagaggtgaaattcgcagatattcggaggaacaccagtggcgtaggcgcccaactggactggtattgacgctgaggcacgaaagcgtggggatcaaacaggattagataccctggtagtccacgccgtaaacgatgtgtgctagctgtcgggagtcttaggctttcggcggcgcagctaacgcattaagcacaccgcctgggaagtacggccgcaaggttaaaactcaaaggaattgacggggacccgcacaagcggtggagcatgttgtttaattcgaagcaacgcgaagaaccttacctactcttgtatcctccttttgactttcagagatgattgtcttcggttcggccgggggagtgacaggtgctgcatggctgtcgtcagctcgtgtcgtgagatgttgggttaagtcccgcaacgagcgcaaccctcatcgtatgttgccatcaggtaatgctgggcactcgtgcgagaccgccggtgataagccggaggaaggtggggacgacgtcaagtcatcatggcccttacgagtagggctacaaacgtgctacaatggtggtgacagtgagcagccactccgcaaggaggagctaatctctaaaagccatctcagttcagattgtcctctgcaactcgagggcatgaagttggaatcgctagtaatcgtggatcagcatgccacggtgaatacgttcccgggtcttgtacacaccgcccgtcacgtcatgggagttggttctacctgaaggcggtacgctaacctatggaggcagccgaccacggtagggtcagtgactgggacgaagtcgtaacaaggtagccgtaggggaacctgcggctggatcacctcctttctaagga

SEQ ID NO: 5707 - DNA, 1529 bp, Microbacterium chocolatum
tttatggagagtttgatcctggctcaggatgaacgctggcggcgtgcttaacacatgcaagtcgaacggtgaagccaagcttgcttggtggatcagtggcgaacgggtgagtaacacgtgagcaacctgccctggactctgggataagcgctggaaacggcgtctaatactggatatgagcctctatcgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtcctttccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacaccctagaaataggggactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggggggagctgtcgaaggtgggatcggtaattaggactaagtcgtaacaaggtagccgtaccggaaggtgcggctggatcacctcctttctaagga

SEQ ID NO: 5708 - DNA, 1525 bp, Microbacterium chocolatum
  ref <308>: DATABASE ACCESSION NUMBER: NCBI ACCESSION: NZ_QTTU01000006.1
  ref <309>: DATABASE ENTRY DATE: 2019-04-01
  ref <313>: RELEVANT RESIDUES IN SEQ ID NO: (1)..(1525)
tttacggagagtttgatcctggctcaggatgaacgctggcggcgtgcttaacacatgcaagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5709 - DNA, 1528 bp, Microbacterium foliorum
tttacggagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatacgagtagcgaccgcatggtcagttactggaaagatttattggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5710 - DNA, 1528 bp, Microbacterium foliorum; identical to SEQ ID NO: 5709

SEQ ID NO: 5711 - DNA, 1530 bp, Microbacterium foliorum
tttacggagagtttgatcctggctcaggatgaacgctggcggcgtgcttaacacatgcaagtcgaacgatgaacccggggcttgctctgggggattagtggcgaacgggtgagtaacacgtgagcaacctgcccctgactctgggataagcgctggaaacggcgtctaatactggatacgaacaagaatcgcatggttacttgttggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaaacccgaggctcaacctcggacctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggcagcgataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaaccccttgtgggagggagctgtcgaaggtgggatcggtaattaggactaagtcgtaacaaggtagccgtaccggaaggtgcggctggatcacctcctttcta

SEQ ID NO: 5712 - DNA, 1528 bp, Microbacterium foliorum
  ref <308>: DATABASE ACCESSION NUMBER: NCBI ACCESSION: NZ_CP031425.1
  ref <309>: DATABASE ENTRY DATE: 2019-04-01
  ref <313>: RELEVANT RESIDUES IN SEQ ID NO: (1)..(1528)
tttacggagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatacgagtagcggccgcatggtcagttactggaaagatttattggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5713 - DNA, 1528 bp, Microbacterium foliorum
tttacggagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatacgagtagcgatcgcatggtcagctactggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5714 - DNA, 1528 bp, Microbacterium ginsengiterrae
  ref <308>: DATABASE ACCESSION NUMBER: NCBI ACCESSION: NZ_RAPT01000001.1
  ref <309>: DATABASE ENTRY DATE: 2019-04-01
  ref <313>: RELEVANT RESIDUES IN SEQ ID NO: (1)..(1528)
tttacggagagtttgatcctggctcaggatgaacgctggcggcgtgcttaacacatgcaagtcgaacggtgaagcaggagcttgctcttgtggatcagtggcgaacgggtgagtaacacgtgagcaacctgccctggactctgggataagcgctggaaacggcgtctaatactggatacgaacaagaatcgcatggttacttgttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaatctggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtcctttccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacacgagaacgggccagaaatggtcaactctttggacactcgtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5715 - DNA, 1529 bp, Microbacterium halotolerans
  ref <308>: DATABASE ACCESSION NUMBER: NCBI ACCESSION: NZ_QVLP01000021.1
  ref <309>: DATABASE ENTRY DATE: 2019-04-01
  ref <313>: RELEVANT RESIDUES IN SEQ ID NO: (1)..(1529)
ttacggagagtttgatcctggctcaggatgaacgctggcggcgtgcttaacacatgcaagtcgaacgatgaagctccagcttgctggggtggattagtggcgaacgggtgagtaacacgtgagcaacctgcccctgactctgggataagcgctggaaacggcgtctaatactggatatgcactgtagccgcatggtttgcagtgggaaagatttatcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagccttcgggtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaatctggaggctcaacctccagcctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagggtggggagcaaacaggcttagataccctggtagtccaccccgtaaacgttgggaactagttgtgggggcctttccacggtctctgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatattcgagaacactgcagaaatgtaggactctttggacactcgtatacaggtggtgcatggttgtcgtcagctcgtgtcgtgagatgttgggttaagtcccgcaacgagcgcaaccctcgttctctgttgccagcacgtaatggtgggaactcaggggatactgccggggtcaactcggaggaaggtggggatgacgtcaaatcatcatgccccttatgtcttgggcttcacgcatgctacaatggccggtacaatgggcagcgataccgtgaggtggagcgaatcccaaaaagccggtcccagttcggatcgtagtctgcaactcgactacgtgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5716 - DNA, 1526 bp, Microbacterium hominis
  ref <308>: DATABASE ACCESSION NUMBER: NCBI ACCESSION: NZ_CP025299.1
  ref <309>: DATABASE ENTRY DATE: 2019-04-01
  ref <313>: RELEVANT RESIDUES IN SEQ ID NO: (1)..(1526)
ggagagtttgatcctggctcaggatgaacgctggcggcgtgcttaacacagcaagtcgtcgaacgtgaaggcccagcttgctgggtggatcagtggcgaacgggtgagtaacacgtgagcaatctgcccctgactctgggataagcgctggaaacggcgtctaatactggatacgagctgcgatcgcatggtcagtagctggaaagattttttggtcaggatgagctcgcgggcctatcagcttgttggtgaggtaatggctcaccaaggcgtcgacgggtagccggcctgagagggtgaccggccacactggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttctaagga

SEQ ID NO: 5717 - DNA, 1527 bp, Microbacterium hydrocarbonoxydans
tttacggagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatacgaaccacgaaggcatcttcagtggttggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5718 - DNA, 1528 bp, Microbacterium hydrocarbonoxydans
tttacggagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatacgaaccatgaaggcatcttcagtggttggaaagatttattggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5719 - DNA, 1527 bp, Microbacterium lacticum
tttacggagagtttgatcctggctcaggatgaacgctggcggcgtgcttaacacatgcaagtcgaacggtgaaggcggagcttgctccgctggatcagtggcgaacgggtgagtaacacgtgagcaatctgcccctgactctgggataagcgctggaaacggcgtctaataccggatacgagctgcgaaggcatcttcagcagctggaaagaacttcggtcagggatgagctcgcggcctatcagctagttggtgaggtaacggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtctgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5720 - DNA, 1526 bp, Microbacterium lemovicicum
  ref <308>: DATABASE ACCESSION NUMBER: NCBI ACCESSION: NZ_CP031423.1
  ref <309>: DATABASE ENTRY DATE: 2019-04-01
  ref <313>: RELEVANT RESIDUES IN SEQ ID NO: (1)..(1526)
tttatggagagtttgatcctggctcaggatgaacgctggcggcgtgcttaacacatgcaagtcgaacggtgaagccaagcttgcttggtggatcagtggcgaacgggtgagtaacacgtgagcaacctgccccggactctgggataagcgctggaaacggcgtctaataccggatatgaaccacagccgcatggttggtggttggaaagattttttggttcgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaaactggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtgggggccattccacggtctccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5721 - DNA, 1526 bp, Microbacterium oleivorans
  ref <308>: DATABASE ACCESSION NUMBER: NCBI ACCESSION: NZ_CP031421.1
  ref <309>: DATABASE ENTRY DATE: 2019-04-01
  ref <313>: RELEVANT RESIDUES IN SEQ ID NO: (1)..(1526)
tttacggagagtttgatcctggctcaggatgaacgctggcggcgtgcttaacacatgcaagtcgaacggtgaagcagagcttgctctgtggatcagtggcgaacgggtgagtaacacgtgagcaacctgcccctgactctgggataagcgctggaaacggcgtctaatactggatatgagctgcgatcgcatggtcagcagttggaaagatttttcggtctgggatgggctcacggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggattggtaattaggactaagtcgtaacaaggtagccgtaccggaaggtgcggctggatcacctcctttcta

SEQ ID NO: 5722 - DNA, 1527 bp, Microbacterium oxydans
tttacggagagtttgatcctggctcaggatgaacgctggcggcgtgcttaacacatgcaagtcgaacggtgaacacggagcttgctctgtgggatcagtggcgaacgggtgagtaacacgtgagcaacctgcccctgactctgggataagcgctggaaacggcgtctaatactggatatgtgacgtgaccgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacctttttggagggagccgtcgaaggtgggatcggtaattaggactaagtcgtaacaaggtagccgtaccggaaggtgcggctggatcacctcctttcta

SEQ ID NO: 5723 - DNA, 1528 bp, Microbacterium paraoxydans; identical to SEQ ID NO: 5713

SEQ ID NO: 5724 - DNA, 1527 bp, Microbacterium paraoxydans; identical to SEQ ID NO: 5722

SEQ ID NO: 5725 - DNA, 1526 bp, Microbacterium phyllosphaerae
tttacggagagtttgatcctggctcaggatgaacgctggcggcgtgcttaacacatgcaagtcgaacggtgaagcccagcttgctgggtggatcagtggcgaacgggtgagtaacacgtgagcaacctgcccctgactctgggataagcgctggaaacggcgtctaatactggatacgagtagcgaccgcatggtcagttactggaaagatttattggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaaggtgggatcggtaattaggactaagtcgtaacaaggtagccgtaccggaaggtgcggctggatcacctcctttcta

SEQ ID NO: 5726 - DNA, 1526 bp, Microbacterium phyllosphaerae
tttacggagagtttgatcctggctcaggatgaacgctggcggcgtgcttaacacatgcaagtcgaacgatgaagcccagcttgctgggtggattagtggcgaacgggtgagtaacacgtgagcaacctgcccctgactctgggataagcgctggaaacggcgtctaatactggatacgagtagcgatcgcatggtcagttactggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgagagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggcagcgataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagctgtcgaaggtgggatcggtaattaggactaagtcgtaacaaggtagccgtaccggaaggtgcggctggatcacctcctttcta

SEQ ID NO: 5727 - DNA, 1526 bp, Microbacterium phyllosphaerae; identical to SEQ ID NO: 5725
  ref <308>: DATABASE ACCESSION NUMBER: NCBI ACCESSION: NZ_RAIJ01000003.1
  ref <309>: DATABASE ENTRY DATE: 2019-04-01
  ref <313>: RELEVANT RESIDUES IN SEQ ID NO: (1)..(1526)

SEQ ID NO: 5728 - DNA, 1525 bp, Microbacterium pygmaeum
  ref <308>: DATABASE ACCESSION NUMBER: NCBI ACCESSION: NZ_LT629692.1
  ref <309>: DATABASE ENTRY DATE: 2019-04-01
  ref <313>: RELEVANT RESIDUES IN SEQ ID NO: (1)..(1525)
tttacggagagtttgatcctggctcaggatgaacgctggcggcgtgcttaacacatgcaagtcgaacggtgaaagagagcttgctctctagatcagtggcgaacgggtgagtaacacgtgagcaatctgcccttgactctgggataagcgttggaaacgacgtctaataccggatacgagctgtgaaggcatcttcaacagctggaaagaacttcggtcaaggatgagctcgcggcctatcagctagttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaaccccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5729 - DNA, 1525 bp, Microbacterium saccharophilum
tttatggagagtttgatcctggctcaggatgaacgctggcggcgtgcttaacacatgcaagtcgaacggtgaaggagagcttgctctctggatcagtggcgaacgggtgagtaacacgtgagcaatctgcccctgactctgggataacagttggaaacagctgctaatactggatacgagacgtgaaggcatcttcaacgtctggaaagaatttcggtcagggatgagctcgcggcctatcagcttgttggtgaggtaacggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgctgcagaaatgtagaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5730 - DNA, 1527 bp, Microbacterium sp. 10M-3C3
  ref <308>: DATABASE ACCESSION NUMBER: NCBI ACCESSION: NZ_CP034245.1
  ref <309>: DATABASE ENTRY DATE: 2019-04-01
  ref <313>: RELEVANT RESIDUES IN SEQ ID NO: (1)..(1527)
tttacggagagtttgatcctggctcaggatgaacgctggcggcgtgcttaacacatgcaagtcgaacggtgaaggagagcttgctctccggatcagtggcgaacgggtgagtaacacgtgagcaacctgccccggactctgggataacagctggaaacagctgctaataccggatacgagctgcgaaggcatcttcagcagctggaaagaatttcggtccgggatgggctcgcggcctatcagcttgttggtgaggtaacggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtctgtcgcgtctgctgtgaaaacccgaggctcaacctcgggcctgcagtgggtacgggcagactagagtgcggtaggggagattggaactcctggtgtagcggtggaatgcgcagatatcaggaagaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatagaggaaacggctggaaacagtcgccccgcaaggtctctatacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttctaagga

SEQ ID NO: 5731 - DNA, 1526 bp, Microbacterium sp. 1294
  ref <308>: DATABASE ACCESSION NUMBER: NCBI ACCESSION: NZ_QTTX01000003.1
  ref <309>: DATABASE ENTRY DATE: 2019-04-01
  ref <313>: RELEVANT RESIDUES IN SEQ ID NO: (1)..(1526)
tttacggagagtttgatcctggctcaggatgaacgctggcggcgtgcttaacacatgcaagtcgaacggtgaagcagagcttgctctgtggatcagtggcgaacgggtgagtaacacgtgagcaacctgcccctgactctgggataagcgctggaaacggcgtctaatactggatatgagctgcgaccgcatggtcagcagttggaaagatttttcggtctgggatgggctcacggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggattggtaattaggactaagtcgtaacaaggtagccgtaccggaaggtgcggctggatcacctcctttcta

SEQ ID NO: 5732 - DNA, 1525 bp, Microbacterium sp. ABRD 28
  ref <308>: DATABASE ACCESSION NUMBER: NCBI ACCESSION: NZ_CP031015.1
  ref <309>: DATABASE ENTRY DATE: 2019-04-01
  ref <313>: RELEVANT RESIDUES IN SEQ ID NO: (1)..(1525)
tttacggagagtttgatcctggctcaggatgaacgctggcggcgtgcttaacacatgcaagtcgaacggtgaaagagagcttgctctctggatcagtggcgaacgggtgagtaacacgtgagcaacctgccccggactctgggataacagctggaaacagctgctaataccggatacgagctgcgaaggcatcttcagcagctggaaagaatttcggtccgggatgggctcgcggcctatcagctagttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5733 - DNA, 1525 bp, Microbacterium sp. AG1240
  ref <308>: DATABASE ACCESSION NUMBER: NCBI ACCESSION: NZ_RBXJ01000005.1
  ref <309>: DATABASE ENTRY DATE: 2019-04-01
  ref <313>: RELEVANT RESIDUES IN SEQ ID NO: (1)..(1525)
tttacggagagtttgatcctggctcaggatgaacgctggcggcgtgcttaacacatgcaagtcgaacggtgaaggagagcttgctctttggatcagtggcgaacgggtgagtaacacgtgagcaatctgcccctgactctgggataacagttggaaacagctgctaataccggatacgagacgtgaccgcatggtcgacgtttggaaagaatttcggtcagggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaactggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggctagaaatagtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5734 - DNA, 1525 bp, Microbacterium sp. AG157
  ref <308>: DATABASE ACCESSION NUMBER: NCBI ACCESSION: NZ_QRDK01000009.1
  ref <309>: DATABASE ENTRY DATE: 2019-04-01
  ref <313>: RELEVANT RESIDUES IN SEQ ID NO: (1)..(1525)
tttatggagagtttgatcctggctcaggatgaacgctggcggcgtgcttaacacatgcaagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttcta

SEQ ID NO: 5735 - DNA, 1527 bp, Microbacterium sp. AG238
  ref <308>: DATABASE ACCESSION NUMBER: NCBI ACCESSION: NZ_RAQC01000005.1
  ref <309>: DATABASE ENTRY DATE: 2019-04-01
  ref <313>: RELEVANT RESIDUES IN SEQ ID NO: (1)..(1527)
tttacggagagtttgatcctggctcaggatgaacgctggcggcgtgcttaacacatgcaagtcgaacggtgaagcagagcttgctctgtggatcagtggcgaacgggtgagtaacacgtgagcaatctgcccctgactctgggataagcgctggaaacggcgtctaataccggatacgagctgcgaccgcatggtcagtagctggaaagaatttcggtcagggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtctgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatagaggaaacgtctggaaacagtcgccccgcaaggtctctatacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttctaagga

SEQ ID NO: 5736 - DNA, 1525 bp, Microbacterium sp. AG790
  ref <308>: DATABASE ACCESSION NUMBER: NCBI ACCESSION: NZ_RBWZ01000003.1
  ref <309>: DATABASE ENTRY DATE: 2019-04-01
  ref <313>: RELEVANT RESIDUES IN SEQ ID NO: (1)..(1525)
ggagagtttgatcctggctcaggatgaacgctggcggcgtgcttaacacatgcaagtcgaacggtgaagcccagcttgctgggtggatcagtggcgaacgggtgagtaacacgtgagcaatctgcccctgactctgggataagcgctggaaacggcgtctaatactggatacgaaccgtggaggcatcttcaacggttggaaagattttttggtcagggatgagctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgctgcagaaatgtagaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtgggatcggtaattaggactaagtcgtaacaaggtagccgtaccggaaggtgcggctggatcacctcctttctaagga
